(12) United States Patent
Ahn et al.

(10) Patent No.: US 12,071,483 B1
(45) Date of Patent: Aug. 27, 2024

(54) BISPECIFIC ANTIBODY TO ALPHA-SYNUCLEIN/INSULIN-LIKE GROWTH FACTOR 1 RECEPTOR AND USE THEREOF

(71) Applicant: ABL Bio Inc., Seongnam-si (KR)

(72) Inventors: Jinhyung Ahn, Seongnam-si (KR); Sungwon An, Seongnam-si (KR); Dongin Kim, Seongnam-si (KR); Eunsil Sung, Seongnam-si (KR); Jaehyun Eom, Seongnam-si (KR); Sang Hoon Lee, Seongnam-si (KR); Weonkyoo You, Seongnam-si (KR); Juhee Kim, Seongnam-si (KR); Kyungjin Park, Seongnam-si (KR); Hyejin Chung, Seongnam-si (KR); Jinwon Jung, Seongnam-si (KR); Bora Lee, Seongnam-si (KR); Byungje Sung, Seongnam-si (KR); Yeunju Kim, Seongnam-si (KR); Yong-Gyu Son, Seongnam-si (KR); Seawon Ahn, Seongnam-si (KR); Daehae Song, Seongnam-si (KR); Jiseon Yoo, Seongnam-si (KR); Youngdon Pak, Seongnam-si (KR); Donghoon Yeom, Seongnam-si (KR); Yoseob Lee, Seongnam-si (KR); Jaeho Jung, Seongnam-si (KR)

(73) Assignee: ABL BIO INC., Seongnam-si (KR)

( * ) Notice: Subject to any disclaimer, the term of this patent is extended or adjusted under 35 U.S.C. 154(b) by 384 days.

(21) Appl. No.: 16/770,728

(22) PCT Filed: Dec. 14, 2018

(86) PCT No.: PCT/KR2018/015953
§ 371 (c)(1),
(2) Date: Jun. 8, 2020

(87) PCT Pub. No.: WO2019/117684
PCT Pub. Date: Jun. 20, 2019

Related U.S. Application Data

(60) Provisional application No. 62/734,391, filed on Sep. 21, 2018, provisional application No. 62/734,388, filed on Sep. 21, 2018, provisional application No. 62/693,474, filed on Jul. 3, 2018.

(30) Foreign Application Priority Data

Dec. 14, 2017 (KR) .................. 10-2017-0172205

(51) Int. Cl.
*A61K 39/395* (2006.01)
*A61K 47/68* (2017.01)
*C07K 16/18* (2006.01)
*C07K 16/28* (2006.01)

(52) U.S. Cl.
CPC ...... *C07K 16/2863* (2013.01); *A61K 47/6845* (2017.08); *C07K 16/18* (2013.01); *C07K 2317/31* (2013.01); *C07K 2317/565* (2013.01); *C07K 2317/567* (2013.01)

(58) Field of Classification Search
None
See application file for complete search history.

(56) References Cited

U.S. PATENT DOCUMENTS

| | | | |
|---|---|---|---|
| 3,773,919 | A | 11/1973 | Boswell et al. |
| 4,816,567 | A | 3/1989 | Cabilly et al. |
| 4,946,778 | A | 8/1990 | Ladner et al. |
| 4,965,195 | A | 10/1990 | Namen et al. |
| 4,968,607 | A | 11/1990 | Dower et al. |
| 5,011,912 | A | 4/1991 | Hopp et al. |
| 5,260,203 | A | 11/1993 | Ladner et al. |
| 5,262,522 | A | 11/1993 | Gearing |
| 5,426,048 | A | 6/1995 | Gearing |
| 5,457,035 | A | 10/1995 | Baum et al. |
| 5,530,101 | A | 6/1996 | Queen et al. |
| 5,545,806 | A | 8/1996 | Lenberg et al. |
| 5,545,807 | A | 8/1996 | Surani et al. |
| 5,585,089 | A | 12/1996 | Queen et al. |
| 5,693,761 | A | 12/1997 | Queen et al. |
| 5,693,762 | A | 12/1997 | Queen et al. |

(Continued)

FOREIGN PATENT DOCUMENTS

| | | |
|---|---|---|
| EP | 0058481 | 8/1982 |
| EP | 0088046 | 9/1983 |

(Continued)

OTHER PUBLICATIONS

Galvin et al. Arch. Neurol. 58: 186-190, 2001.*
Lee et al. J. Mov. Disord. 9(1): 14-19, 2016.*
Nimmo et al. Alzheimer's Res. Ther. 12: 159, 2020, 16 pages.*
Peter Blume-Jensen et al., "Oncogenic kinase signalling", Nature, 2001, 411:355-65.
Vicky A. Blakesley et al., "IGF-1 Receptor Function IGF-1 receptor function: transducing the IGF-1 signal into intracellular events", The IGF System, Humana Press, 1999, NJ: 143-63.
Songsivilai et al., "Bispecific antibody: a tool for diagnosis and treatment of disease", 1990, Clin. Exp. Immunol. 79:315-321.

(Continued)

*Primary Examiner* — Christine J Saoud
(74) *Attorney, Agent, or Firm* — Steptoe LLP; Z. Ying Li; Wyan-Ching M. Lee

(57) ABSTRACT

The present invention relates to a bi-specific antibody that specifically binds to alpha-synuclein and IGF1R, and use of the bi-specific antibody for treating or diagnosing synucleinopathies associated with alpha-synuclein or alpha-synuclein aggregates. The IGF1R portion of the bi-specific antibody acts as a shuttle to penetrate the blood brain barrier, allowing the alpha-synuclein portion to exert its action in the brain. Further, the half-life of the bi-specific antibody may be extended to maintain efficacy over time.

18 Claims, 53 Drawing Sheets

Specification includes a Sequence Listing.

(56) References Cited

U.S. PATENT DOCUMENTS

| | | |
|---|---|---|
| 5,874,299 A | 2/1999 | Lenberg et al. |
| 5,877,397 A | 3/1999 | Lenberg et al. |
| 6,162,963 A | 12/2000 | Kucherlapati et al. |
| 6,180,370 B1 | 1/2001 | Queen et al. |
| 6,255,458 B1 | 7/2001 | Lonberg et al. |
| 6,270,964 B1 | 8/2001 | Michnick et al. |
| 6,300,129 B1 | 10/2001 | Lonberg et al. |
| 6,673,986 B1 | 1/2004 | Kucherlapati et al. |
| 6,713,610 B1 | 3/2004 | Kucherlapati et al. |
| 8,609,820 B2 | 12/2013 | Saldanha et al. |
| 8,940,276 B2 | 1/2015 | Weihofen et al. |
| 9,534,044 B2 | 1/2017 | El-Agnaf |
| 2009/0068110 A1 | 3/2009 | Shang et al. |
| 2010/0028370 A1 | 2/2010 | Zankel et al. |
| 2011/0014117 A1 | 1/2011 | Wang et al. |
| 2011/0300077 A1 | 12/2011 | Weihofen et al. |
| 2012/0308572 A1 | 12/2012 | Nordström et al. |
| 2014/0363447 A1 | 12/2014 | Nordstrom et al. |
| 2015/0093399 A1 | 4/2015 | Jefferies |
| 2015/0196663 A1 | 7/2015 | Shusta et al. |
| 2015/0266947 A1 | 9/2015 | Sierks et al. |
| 2016/0108113 A1 | 4/2016 | Ayalon et al. |
| 2017/0015748 A1 | 1/2017 | Stanimirovic et al. |
| 2017/0355756 A1 | 12/2017 | Julien et al. |
| 2022/0348665 A1 | 11/2022 | An et al. |
| 2022/0380446 A1 | 12/2022 | Ahn et al. |
| 2023/0227540 A1 | 7/2023 | Ahn et al. |
| 2023/0279085 A1 | 9/2023 | Lee et al. |
| 2023/0357412 A1 | 11/2023 | An et al. |

FOREIGN PATENT DOCUMENTS

| | | |
|---|---|---|
| EP | 0133988 | 3/1985 |
| EP | 0143949 | 6/1985 |
| EP | 0367566 | 5/1990 |
| EP | 0460846 | 12/1991 |
| EP | 0546073 | 6/1993 |
| EP | 2450056 | 5/2012 |
| EP | 3567054 A1 | 11/2019 |
| EP | 3567054 A4 | 3/2021 |
| EP | 3725802 A4 | 8/2021 |
| EP | 3725806 A4 | 3/2022 |
| JP | 2012-512634 | 6/2012 |
| JP | 2013-525266 | 6/2013 |
| JP | 2014-221835 | 11/2014 |
| JP | 2015-232002 | 12/2015 |
| JP | 2016-511254 | 4/2016 |
| JP | 2017-501848 | 1/2017 |
| JP | 2017-512464 | 5/2017 |
| JP | 2017-513461 | 6/2017 |
| JP | 2017-514456 | 6/2017 |
| JP | 2017-536102 | 12/2017 |
| KR | 10-2011-0110200 | 10/2011 |
| KR | 10-2011-0110220 | 10/2011 |
| KR | 10-2012-0047274 | 5/2012 |
| KR | 10-2013-0137654 | 12/2013 |
| KR | 10-2014-0053974 | 5/2014 |
| KR | 10-2014-0095074 | 7/2014 |
| KR | 10-2014-0125409 | 10/2014 |
| KR | 10-2014-0138533 | 12/2014 |
| KR | 10-1512853 | 4/2015 |
| KR | 10-2015-0063447 | 6/2015 |
| KR | 10-2016-0010402 | 1/2016 |
| KR | 10-2016-0127115 | 11/2016 |
| KR | 10-2016-0127815 | 11/2016 |
| KR | 10-2017-0041289 | 4/2017 |
| KR | 10-2019-0057004 | 5/2019 |
| WO | 1990/04036 | 4/1990 |
| WO | 1991/10741 | 7/1991 |
| WO | 1993/15722 | 8/1993 |
| WO | 1994/02602 | 2/1994 |
| WO | 1994/20069 | 9/1994 |
| WO | 1996/33735 | 10/1996 |
| WO | 1999/10494 | 3/1999 |
| WO | 2002-053596 | 7/2002 |
| WO | 2002/053596 | 7/2002 |
| WO | 2005/016967 | 2/2005 |
| WO | 2005-016967 | 2/2005 |
| WO | 2006/013472 | 2/2006 |
| WO | 2006-013472 | 2/2006 |
| WO | 2006/138729 | 12/2006 |
| WO | 2007/042289 | 4/2007 |
| WO | 2007042289 | 4/2007 |
| WO | 2008/068048 A2 | 6/2008 |
| WO | 2006-138729 | 2/2009 |
| WO | 2010/066868 | 6/2010 |
| WO | 2010-066868 | 9/2010 |
| WO | 2011/104696 | 9/2011 |
| WO | 2011/107544 | 9/2011 |
| WO | 2014/132210 | 9/2014 |
| WO | 2014-132210 | 9/2014 |
| WO | 2015/075011 | 5/2015 |
| WO | 2015-131257 | 9/2015 |
| WO | 2015/131257 | 9/2015 |
| WO | 2016/061389 | 4/2016 |
| WO | 2017/009312 | 1/2017 |
| WO | 2018/128454 | 7/2018 |
| WO | 2018-128454 | 7/2018 |
| WO | 2018/213316 | 11/2018 |
| WO | 2019/098763 A3 | 11/2018 |
| WO | 2019/023809 | 2/2019 |
| WO | 2019/098763 | 5/2019 |
| WO | 2019/117684 | 6/2019 |
| WO | 2019/117684 A1 | 6/2019 |
| WO | 2019/117685 | 6/2019 |
| WO | 2020/251316 | 12/2020 |
| WO | 2020/251316 A1 | 12/2020 |
| WO | 2022/238961 | 11/2022 |

OTHER PUBLICATIONS

Sheri A. Kostelny et al., "Formation of a Bispecific Antibody by the Use of Leucine Zippers", 1992, J. Immunol. 148:1547-1553.

Anonymous, "Blood-brain barrier molecular carriers for Parkinson's disease", Biopharmadealmakers, 2017.

"*Homo sapiens* synuclein, alpha (non A4 component of amyloid precursor), partial [synthetic construct]", NCBI, Genbank Accession No. AAP36433.1.

Shu-Lian Li et al., "Two New Monoclonal Antibodies Against the Alpha Subunit of the Human Insulin-Like Growth Factor-I Receptor", Biochemical and Biophysical Research Communications, Elsevier, Amsterdam NL, vol. 196, No. 1, Oct. 15, 1993, pp. 92-98.

Ahn et al., "A Monoclonal Antibody against the Paraneoplastic Pemphigus (PNP) Antigen, Envoplakin: cDNA Sequences Encoding the Variable Regions of Heavy and Light Chains," Molecules and Cells (2004) 18(2):237-41.

Bae et al., "Antibody-Aided Clearance of Extracellular Alpha-Synuclein Prevents Cell-to-Cell Aggregate Transmission," The Journal of Neuroscience (2012) 32(39):13454-69.

Blakesley et al., "IGF-1 Receptor Function IGF-1 receptor function: transducing the IGF-1 signal into intracellular events," The IGF System, Humana Press, 1999, NJ: 143-63.

Blume-Jensen et al., "Oncogenic kinase signalling," Nature (2001) 411:355-65.

Brundin et al., "Prion-like transmission of protein aggregates in neurodegenerative diseases," Nat Rev Mol Cell Biol. (2010) 11(4):301-7.

Kim et al., "Alpha-synuclein biology in Lewy body diseases," Alzheimer's Research & Therapy (2014) 6(73):1-9.

Kostelny et al., "Formation of a Bispecific Antibody by the Use of Leucine Zippers," J. Immunol. (1992) 148:1547-53.

Lee et al., "Clearance of Alpha-Synuclein Oligomeric Intermediates via the Lysosomal Degradation Pathway," The Journal of Neuroscience (2004) 24(8):1888-96.

Li et al., "Two New Monoclonal Antibodies Against the Alpha Subunit of the Human Insulin-Like Growth Factor-I Receptor," Biochemical And Biophysical Research Communications (1993) 196(1):92-8.

Murphy et al., "Synucleins Are Developmentally Expressed, and a-Synuclein Regulates the Size of the Presynaptic Vesicular Pool in Primary Hippocampal Neurons," The Journal of Neuroscience (2000) 20(9):3214-20.

(56) References Cited

OTHER PUBLICATIONS

Myohanen et al., "A prolyl oligopeptidase inhibitor, KYP-2047, reduces a-synuclein protein levels and aggregates in cellular and animal models of Parkinson's disease," British Journal of Pharmacology (2012) 166:1097-113.
Paul, Fundamental Immunology, 5th edition, Aug. 2003, Lippincott Williams & Wilkins Publishers.
Singleton et al., "Alpha-Synuclein Locus Triplication Causes Parkinson's Disease," Science (2003) 302:841.
Songsivilai et al., "Bispecific antibody: a tool for diagnosis and treatment of disease," Clin. Exp. Immunol. (1990) 79:315-21.
Vaikath et al., "Generation and characterization of novel conformation-specific monoclonal antibodies for [alpha]-synuclein pathology," Neurobiology of Disease (2015) 79:81-99.
Wagner et al., "Anle138b: a novel oligomer modulator for disease-modifying therapy of neurodegenerative diseases such as prion and Parkinson's disease," Acta Neuropath (2013) 125:795-813.
Chen et al. "Enhancement and destruction of antibody function by somatic mutation: unequal occurrence is controlled by V gene combinatorial associations," EMBO (1995) 14(12):2784-94.
Kussie et al. "A Single Engineered Amino Acid Substitution Changes Antibody Fine Specificity," J Immunol. (1994) 152(1):146-52.

\* cited by examiner

| Clones | EC50 (ng/ml) | | EC50 (nM) | |
|---|---|---|---|---|
| | Monomers | Fibrils | Monomers | Fibrils |
| 3A9 | - | 319.4 | - | 2.129 |
| 9B11 | - | 184.9 | - | 1.233 |
| 11F11 | - | 326.5 | - | 2.177 |

| Clones | KD (M, X10$^{-9}$) | |
|---|---|---|
| | Monomers | Fibrils |
| 3A9 | - | 1.320 |
| 9B11 | - | 0.904 |
| 11F11 | - | 2.873 |

-:tested, but not available

FIG. 3B

| Clones | KD ($10^{-9}$ M) | |
|---|---|---|
| | Monomers | Fibrils |
| 3A9 | - | 0.13 |
| 9B11 | - | 0.018 |
| 11F11 | - | 0.16 |

-: tested, but not available

| Sample Name | MFI | | |
|---|---|---|---|
| | JIMT-1 | BT474 | MCF7 |
| Untreated | 1.36 | 1.8 | 2.51 |
| 2$^{nd}$ Ab only | 1.89 | 1.93 | 4.53 |
| #996 Ab | 5.03 | 3.51 | 7.07 |
| #1226 Ab | 3.50 | 3.01 | 5.60 |
| #1564 Ab | 5.16 | 3.95 | 6.34 |
| IMC-A12 | 22.99 | 18.34 | 40.08 |
| MKJP2 | 20.67 | 16.43 | 26.67 |

| Samples | MFI |
|---|---|
| Secondary Ab only | 3.20 |
| ch11F11 | 3.26 |
| ch11F11-1564 | 4.37 |
| 1564 IgG | 7.55 |

*201: Herceptin Biosimilar

| 1564 Location within | Site | Temperature (4 °C) | Modification | % Content |
|---|---|---|---|---|
| LCDR1 | scFV(483-511) | 4 | Unmodified | 99.2 |
| LCDR1 | scFV(483-511) | 40 | Deamidated | 0.8 |
| LCDR1 | scFV(483-511) | 4 | Unmodified | 99.0 |
| LCDR1 | scFV(483-511) | 40 | Deamidated | 1.0 |
| LCDR2 | scFV(512-527) | 4 | Unmodified | 84.7 |
| LCDR2 | scFV(512-527) | 40 | Deamidated | 15.3 |
| LCDR2 | scFV(512-527) | 4 | Unmodified | 83.1 |
| LCDR2 | scFV(512-527) | 40 | Deamidated | 16.9 |
| LCDR3 | scFV(546-571) | 4 | Unmodified | 95.4 |
| LCDR3 | scFV(546-571) | 40 | Deamidated | 4.6 |
| LCDR3 | scFV(546-571) | 4 | Unmodified | 90.2 |
| LCDR3 | scFV(546-571) | 40 | Deamidated | 9.8 |
| HCDR2 | scFV(639-660) | 4 | Unmodified | 55.8 |
| HCDR2 | scFV(639-660) | 40 | Deamidated | 44.2 |
| HCDR2 | scFV(639-660) | 4 | Unmodified | 52.7 |
| HCDR2 | scFV(639-660) | 40 | Deamidated | 47.3 |
| 1564_Frame work | scFV(672-682) | 4 | Unmodified | 95.6 |
| 1564_Frame work | scFV(672-682) | 40 | Deamidated | 4.4 |
| 1564_Frame work | scFV(672-682) | 4 | Unmodified | 95.7 |
| 1564_Frame work | scFV(672-682) | 40 | Deamidated | 4.3 |

FIG. 18A

| CDR (residue, peptide) | Mutants |
|---|---|
| LCDR2 (N51, LLIYANSN) | N51D |
| LCDR3 (N95a residue, GAWDDSLNG) | N95aK |
| | N95aH |
| | N95aR |
| | N95aD |
| HCDR2 (N54, AISYDNGNT) | N54D |
| | N54Q |

FIG. 18B

BISPECIFIC ANTIBODY TO ALPHA-SYNUCLEIN/INSULIN-LIKE GROWTH FACTOR 1 RECEPTOR AND USE THEREOF

CROSS-REFERENCES TO RELATED APPLICATIONS

This application is a national stage application under 35 U.S.C. § 371 of International Patent Application PCT/KR2018/015953, filed Dec. 14, 2018, which claims priority from Korean Patent Application 10-2017-0172205, filed Dec. 14, 2017, and U.S. Provisional Patent Applications 62/734,388, filed Sep. 21, 2018; 62/734,391, filed Sep. 21, 2018; and 62/693,474, filed Jul. 3, 2018. The disclosures of the aforementioned priority applications are incorporated by reference herein in their entirety.

SEQUENCE LISTING

The instant application contains a Sequence Listing that has been submitted electronically in ASCII format and is hereby incorporated by reference in its entirety. Said ASCII copy is named 122548.US013_ST25.txt, is 947,631 bytes in size, and was created on Nov. 28, 2023.

TECHNICAL FIELD

The present invention relates to a bispecific antibody against alpha-synuclein and IGFR, a pharmaceutical composition for prevention and/or treatment of synucleinopathies (α-synucleinopathies) including the bispecific antibody, and a method of detecting alpha-synuclein aggregates or providing information for diagnosing alpha-synucleinopathies including the bispecific antibody.

RELATED ART

Alpha-synuclein (α-synuclein, α-syn) is expressed primarily in the presynaptic terminals of neurons, and is a naturally unfolded monomer in normal conditions. Alpha-synuclein helps to regulate the release of dopamine, a neurotransmitter controlling voluntary or involuntary movements. Particularly, the function of alpha-synuclein is important with increased synaptic activity and aging, and is an important factor of neurodegeneration.

However, in the pathological state, alpha-synuclein undergoes structural changes through binding and interaction with droplets, phospholipid bilayers, or lipid membranes to form a folded or folded α-helical secondary structure, thereby dividing the amount. Agglomerates comprising molecules in the form of dimers, oligomers and/or fibers are formed.

These alpha-synuclein aggregates have been known to induce toxicity to cells, and are the major component of abnormal protein aggregates (Lewy bodies) that are found in neurons of Parkinson's disease (PD), Parkinson's disease dementia (PDD), multiple system atrophy (MSA), dementia with Lewy bodies (DLB), and various diseases. It is also known that post-translational modifications of alpha-synuclein, such as phosphorylation, or ubiquitination, are also associated with aggregation and neurotoxicity of alpha-synuclein. Alpha-synuclein has been known to kill dopamine neurons and cause inflammatory reactions in animal experiments and cell experiments, and to cause motor symptoms similar to Parkinson's disease in experimental animals. In addition, alpha-synuclein aggregation has been known to be related to an etiology of a group of neurodegenerative diseases called α-synucleinopathies, including Parkinson's disease, Parkinson's disease dementia, Lewy body dementia, multiple system atrophy and many other neuro-axonal diseases.

Antibodies to alpha-synuclein or fragments of alpha-synuclein to induce such antibodies have been proposed as methods of immunotherapy against synuclein disease. However, brain penetration of antibodies may be limited by the blood brain barrier (BBB).

In addition, the deficiency of highly-specific BBB carriers has delayed the development of new therapeutics and diagnostics for diseases originating in the brain, including brain tumors and neurodegenerative diseases. There is clearly a need for a method for delivering therapeutic and diagnostic molecules at a pharmaceutically effective dose to the brain without disrupting the physiology and homeostasis of BBB.

DETAILED DESCRIPTION

Technical Problem

An embodiment of the present invention provides a protein complex comprising an antigen-binding region against alpha-synuclein (α-syn) and an antigen-binding region against IGF1R, or a method for preparing the protein complex.

Another embodiment provides a polynucleotide encoding the protein complex, a recombinant vector comprising the same, and a recombinant cell comprising the same.

A further embodiment provides a bispecific antibody against α-syn and IGF1R obtained from the protein complex and a method for preparing the same.

A further embodiment provides a pharmaceutical composition for prevention and/or treatment of alpha-synucleinopathies, comprising the bispecific antibody against α-syn and IGF1R and a pharmaceutically acceptable excipient.

Provided is a method for delivering drugs used for diagnosis, treatment or prevention of alpha-synucleinopathies to brain, using the antibody or antigen-binding fragment of the present invention.

Technical Solution

Hereinafter, the present invention will be described in more detail.

An embodiment of the present invention is a protein complex comprising an antigen binding region for alpha-synuclein (α-syn) and an antigen binding region for IGF1R, and a bispecific antibody against alpha-synuclein and IGF1R (hereinafter, anti-α-syn/anti-IGF1R bispecific antibody) obtained from the protein complex. Therefore, the bispecific antibody of the present invention can recognize and bind to both alpha-synuclein and IGF1R as antigens.

The anti-α-syn/anti-IGF1R bispecific antibody of the present invention includes anti-alpha-synuclein antibody or an antigen-binding fragment thereof, and specifically recognizes and binds to alpha-synuclein, especially the C-terminal region of alpha-synuclein, thereby being used for prevention, treatment and/or diagnosis of the diseases related with alpha-synuclein or alpha-synuclein aggregates, namely alpha-synucleinopathies.

According to the present invention, the term "synucleinopathies" includes all neurodegenerative disorders characterized by pathological synuclein aggregates. Parkinson's disease, Parkinson's disease dementia (PDD), dementia with Lewy body (DLB), Lewy body disease, dementia accompanied with Lewy bodies, Parkinson's syndrome with dementia, multiple system atrophy (MSA), multiple nervous system atrophy, and neurodegeneration type I with brain iron accumulation (NBIA Type I), are collectively grouped as synucleinopathies. In addition, the aggregations of alpha-synucleins have been also found secondary in Alzheimer's disease (Kim et al., Alzheimer's Research & Therapy 2014, 6:73).

The synucleinopathies are diverse groups of neurodegenerative disorders that share common pathological properties. In neuropathic aspects, the distinct lesions can be detected as the abnormal aggregation of alpha-synuclein in the selected groups of neurons and oligodendrocytes. Alpha-synuclein (formerly known as PARK1 and PARK4) is a protein comprised of 140 amino acids that is widely expressed in the neocortex, hippocampus, dentate gyrus, posterior neurosphere, striatum, thalamus and cerebellum. Alpha-synuclein is also highly expressed in hematopoietic cells including monocytes such as B cells, T cells, and NK cells and platelets. The accurate role in these cells has been unknown, but associated with differentiation of megakaryocytes (platelet precursors).

Herein, "a disease associated with alpha-synuclein aggregates" is a group of neurodegenerative diseases called synucleinopathies, in which alpha-synuclein aggregates are found in lesions including neurons and glia, and has characteristics such as dopamine system degeneration, mobility change, cognitive impairment, and formation of Lewy bodies and/or Lewy Neurites (Kim et al., Alzheimer's Research & Therapy 2014, 6:73; McKeith et al., Neurology (1996) 47:1113-24). These diseases include, but are not limited to, Parkinson's disease, Parkinson's disease dementia, Lewy body dementia, Lewy body variant of Alzheimer's disease, combined Alzheimer's and Parkinson's disease, multiple system atrophy, and many other neuroaxonal diseases. In one embodiment, the antibody according to the present invention is effectively used for treating Parkinson's disease.

In addition, the anti-α-syn/anti-IGF1R bispecific antibody of the present invention includes an anti-IGF1R antibody or antigen-binding fragment thereof, so that the anti-α-syn antibody or antigen-binding fragment thereof can penetrate the blood brain barrier to exert its action, and the half-life may be extended to maintain efficacy for a long time.

Moreover, the anti-α-syn/anti-IGF1R bispecific antibody of the present invention binds to IGF1R on the cell surface without affecting the binding of the ligand, and has properties of no effect on the signaling pathway through IGF1R. Because it does not inhibit the binding of IGF1R to its ligand and signaling through IGF1R, it can be used as a shuttle means to penetrate the blood brain barrier.

Particularly, the anti-IGF1R antibody or antigen-binding fragment thereof of the present invention specifically recognizes IGF1R and binds to IGF1R, particularly human IGF1R, mouse IGF1R, rat IGF1R, and monkey IGF1R. However, it does not interfere with the binding of IGF1R ligand such as IGF-1, IGF-2 and/or insulin to IGF1R and does not inhibit signal transduction through IGF1R, and can be used for transcytosis to pass through BBB. It does not have antibody-dependent cell-mediated cytotoxicity (ADCC), and thus does not decrease IGF1R levels in the brain even when administered to animals repeatedly, thereby having no toxicity.

In particular, the anti-IGF1R antibody of the present invention binds to IGF1R located on the surface of brain endothelial cells constituting BBB and internalizes into the inner part of the cell. For example, whether the anti-IGF1R antibody of the present invention is internalized into cells can be identified by using a cell line expressing IGF1R (e.g., MCF-7). Anti-IGF1R antibodies of the present invention, e.g., 1564, 48G5, 54H4, 60H6, B11 and affinity variants of 1564 such as C04, F06, VH2, VH5, VH7, VH9, VH16, VH32 and VH35 have a higher internalization degree compared to the negative control. The results suggest that the internalization degree of the tested anti-IGF1R antibodies is specific to IGF1R on the cell surface. In addition, the anti-IGF1R antibody of the present invention is in scFv form, and can be produced as being linked to a therapeutic antibody in various ways. For example, the scFv of an anti-IGF1R antibody can be prepared in a bispecific antibody, for example a bivalent form of a bispecific antibody in which two scFvs bind to a C-terminus of the therapeutic antibody, for example, α-syn antibody, or a monovalent form of a bispecific antibody in which one scFv binds to a C-terminus of the therapeutic antibody. Both of these bispecific antibodies can internalize into cells expressing IGF1R. The IGF1R antibody has a high binding affinity to the antigen on the cell surface, which enhances the internalization effect and leads to BBB-passing ability. However, if the antibody has the ability to pass the BBB and interferes with the signaling of IGF1R, it can cause side effects. The antibody of present invention is characterized in both the binding capacity suitable for a BBB shuttle and the non-blocking property for IGF1R signaling.

The anti-IGF1R antibody or antigen-binding fragment thereof has excellent property to be developed easily. In this aspect, the post-translational modification, such as deamidation, that occurs in the CDR region of the anti-IGF1R antibody and reduces the stability and efficacy of the antibody is to be removed. By substituting the amino acid at which the deamidation occurs, the stability and efficacy of the antibody is increased compared to the parental antibody, without changing the binding capacity to the ECD of antigen IGF1R. The mutants are prepared by substituting Asn of the deamination site with other residues including Q, H, and K one by one, and the binding affinities of the mutants are confirmed to be similar to that of parental antibody, as a result of ELISA analysis for the binding affinity of the mutants to IGF1R.

Additionally, when linked to a bioactive substance acting in the brain, the anti-IGF1R antibody of the present invention can induce improved BBB-penetrating ability and efficacy compared to the bioactive substance alone.

The anti-IGF1R antibody according to one aspect of the present invention may be used as a bispecific antibody including various second therapeutic antibodies. It is shown that the BBB penetrating property is 15-fold higher than the single antibody composed of only a therapeutic antibody, in the penetrating experiment using an in vitro BBB system derived from human IPSC (FIG. 16A). The anti-IGF1R antibody may be bound to the second antibody in the bispecific antibody in a monovalent or bivalent form. For example, when analyzing the amount of antibody in blood and CSF after single administration of bispecific antibody with monovalent form or bivalent form anti-IGF1R antibody to a normal rat, the monovalent form and the bivalent form of anti-IGF1R antibodies showed up to 5-fold increased amount in blood and up to 5-fold increased amount in CSF, compared to parental anti-IGF1R antibody (clone 1564). They showed about 3-fold increased amount in CSF and about 4.5-fold increased amount of brain penetrating properties, compared to the parental anti-IGF1R antibody (clone 1564) (FIG. 16C). Therefore, the bispecific antibody including the anti-IGF1R antibody improved by the above method is expected to show up to about 15 times the amount in CSF and about 23 times the capacity of antibody to penetrate brain compared to the single antibody composed of the therapeutic second antibody alone.

The anti-IGF1R antibody of the present invention has been identified to bind to IGF1R, particularly IGF1R of mammals including humans, monkeys, rats, and mice, and thus can be useful for screening for drug development, clinical trials, and the like.

The anti-IGF1R antibody or antigen-binding fragment of the present invention is an antibody or antigen-binding fragment thereof that specifically recognizes IGF1R (Insulin-like Growth Factor 1 Receptor).

The anti-IGF1R antibody or antigen-binding fragment of the present invention "specifically binds" to its target, such as an antigen, when it binds to it at the dissociation constant ($K_D$) of $\leq 10^{-6}$ M. The antibody specifically binds to the target with high affinity, when $K_D$ is $\leq 1 \times 10^{-8}$ M or when the effective concentration 50 ($EC_{50}$) is 2 nM or less. In one embodiment, the antibody or antigen-binding fragment thereof is capable of binding to IGF1R or human IGF1R with a $K_D \leq 1 \times 10^{-8}$. It has been found that the antibodies disclosed herein bind to IGF1R, especially human IGF1R, mouse IGF1R, rat IGF1R, and monkey IGF1R.

As used herein, the term "epitope" is an antigenic determinant, which is interpreted to mean a portion of the antigen recognized by the antibody. According to one embodiment, the binding site of the anti-IGF1R antibody of the present invention may be an extracellular domain of IGF1R protein, for example, a human IGF1R protein (SEQ ID NO: 410). More specifically, the binding sites of the anti-IGF1R antibody of the present invention, for example, 1564 clone antibody for the human IGF1R protein, are binding site 1 including Y775, P776, F778, R650, S791, L798 and Glu779, binding site 2 including L641, H808, E809 and L813, and binding site 3 including V397, D435, W434, Y460 and C488, in a protein consisting of the amino acid sequence of SEQ ID NO: 410. Thus, the epitope of the IGF1R antibody of the present invention may be the conformational epitope that include all or part of the three binding sites.

As used herein, the term "antibody" refers to a substance produced by stimulation of an antigen in the immune system, and may be produced in vivo, recombinantly produced, or artificially synthesized, but not particularly limited. The antibodies in the present invention include animal antibodies, chimeric antibodies, humanized antibodies, and human antibodies. In addition, in the present invention, the antibody also includes an antigen-binding fragment of an antibody having an antigen-binding ability.

The antibody also includes a monoclonal antibody and a polyclonal antibody, and the monoclonal antibody may be a human antibody, a humanized antibody, or a chimeric antibody that is an isolated antibody specifically binding to IGF1R. The monoclonal antibody is an isolated antibody specifically binding to IGF1R as IgG1, IgG2, IgG3 or IgG4 types.

Antibodies of the present invention include, but are not limited to, bispecific antibodies, minibodies, domain antibodies, antibody mimetics (or synthetic antibodies), antibody fusions (or antibody conjugates), and fragments thereof. The structure of various antibodies is further disclosed herein below.

As used herein, the term "antigen binding fragment" refers to a part of an antibody or a polypeptide including the same, having a specific binding affinity to antigen. For example, a part of an antibody includes an amino acid residue providing the specificity and affinity to an antigen by interacting with the antigen. This antigen-binding region typically comprises one or more "complementary determining regions" (CDRs). A specific antigen-binding region also comprises one or more "framework regions" (FRs). CDRs are the amino acid sequences that contribute to the specificity and affinity of antigen binding. The framework region helps to maintain an appropriate conformation of these CDRs, thereby facilitating binding between the antigen-binding region and an antigen.

In the present invention, "complementarity-determining region" (CDR) means a region that confers the binding specificity to an antigen in the variable regions of an antibody.

The antibody may be selected from all subtypes of immunoglobulins (e.g., IgA, IgD, IgE, IgG (IgG1, IgG2, IgG3, IgG4), IgM, etc.). The IgG form of the antibody may be of the IgG1, IgG2, IgG3, or IgG4 subtype, for example IgG1 or IgG2 subtype. The IgG type antibody comprises two heavy chains and two light chains, and each heavy chain and light chain are combined through disulfide bonds to form two heavy chain-light chain dimers, and the formed two heavy chain-light chains are linked through a disulfide bond at the Fc region of the heavy chain. The IgG form of the antibody comprises a single target antibody targeting one antigen, including antigen binding sites for the same antigen in both heavy chain-light chain constructs, or bispecific antibody targeting two antigens, including antigen-biding sites for different antigens in heavy chain-light chain constructs.

The term "antigen-binding fragment" of a chain (heavy chain or light chain) of an antibody or immunoglobulin includes a part of an antibody which lacks some amino acids compared to a full-length chain, but can specifically bind to an antigen. This fragment can be considered as having biological activity, in an aspect that it can specifically bind to a target antigen, or can compete to other antibodies or an antigen-binding fragment to bind a specific epitope. Specifically, the antigen-binding fragment is selected from the group consisting of antibody fragments including one or more of the complementarity determining regions, such as scFv, (scFv)$_2$, scFv-Fc, Fab, Fab' and F(ab')$_2$, but is not limited to thereto. Such biologically active fragments can be produced by recombinant DNA technology, or can be produced by enzymatic or chemical cleavage of intact antibodies. The immunologically functional immunoglobulin fragments are not limited thereto.

In the present invention, for example, a "variant" of a polypeptide, such as an antigen-binding fragment, protein, or antibody, is a polypeptide in which insertion, deletion, addition, and/or substitution occurs at one or more amino acid residues compared to other polypeptide sequences, and includes fusion polypeptides. For example, some of the antibodies include conservative amino acid substitutions in one or more residues of the heavy or light chain, variable region or CDR sequence.

The term "derivative" of a polypeptide in the present invention means a polypeptide that is chemically modified through conjugation with other chemical moieties, and is different from insertion, deletion, addition or substitution variants.

The anti-IGF1R antibody or antigen-binding fragment of the present invention does not prevent the binding of IGF1R ligands such as IGF-1, IGF-2, and/or insulin to IGF1R. Specifically, the anti-IGF1R antibody or antigen-binding fragment does not interfere with binding of the IGF1R ligand to the IGF1R located on the membrane of the cells expressing IGF1R, and neither inhibits signal transduction through IGF1R nor affects the expression of IGF1R on the cell surface, advantageously. Thus, the anti-IGF1R antibody or antigen-binding fragment of the present invention can be effectively used to penetrate the blood brain barrier through transcytosis.

Human IGF1R can be activated by insulin-like growth factors, IGF-1 and IGF-2 and insulin (INS). The signaling through IGF1R promotes cell growth and survival through an IRS adapter protein dependent on activation of the PI3 Kinase/Akt pathway. IGF1R signals its major substrates of IRS-1, IRS-2, IRS-3 and IRS-4 and Shc proteins, resulting in the activation of Ras/Raf/MAP kinase and PI3 kinase/Akt signaling pathways. IGF1R has been shown to have a relatively high expression level in the brain compared to other transcytosis targets which have been used currently and have been known to be expressed in endothelial cells of the brain for improving the ability to penetrate BBB.

The anti-IGF1R antibody of the present invention does not interfere with the binding of IGF1, IGF2 and/or insulin to IGF1R and does not interfere with the signaling pathway through IGF1R as described above. In addition, in one embodiment of the present invention, when IGF1R is compared to other targets currently being developed for the purpose of improving the BBB-penetrating capacity of therapeutic antibodies, for example, transferrin receptor, or insulin receptor, it has been shown to have a relatively low expression level in normal brain and peripheral tissue such as the liver, lungs, or large intestine.

IGF1R is a target of Receptor Mediated Transcytosis (RTM), which can deliver useful substances through the blood brain barrier (BBB) into brain. However, in order to be used as a drug delivery target for penetrating the blood-brain barrier, it is desirable to have a property binding to IGF1R on the cell surface without affecting the binding of the ligand and the signaling pathway through IGF1R. Thus, the anti-IGF1R antibody and antigen-binding fragment thereof of the present invention does not inhibit the binding of IGF1R to its ligand and signaling through IGF1R, and thus can be used as a shuttle means to penetrate the blood brain barrier.

The anti-IGF1R antibody or antigen-binding fragment of the present invention is capable of transcytosis and can pass through endothelial cells of brain. In addition, the antibody of the present invention is located in the same place as the brain blood vessels of the mouse, when it is injected into a blood vessel of mouse. These results indicate that the antibody or antigen-binding fragment of the present invention can be effectively used as a drug carrier that crosses the blood brain barrier.

Therefore, the anti-IGF1R antibody or antigen-binding fragment of the present invention allows the bioactive substance acting in brain to pass through the blood brain barrier. In the present invention, the biological barrier refers to cells, tissues, membranes, or a cell, membrane, or structure that prevents effective passage, diffusion, or transfer of biological molecules. These biological barriers include nerve cells/tissues, connective tissue, muscle, membrane or epithelial (e.g., mucosal or vascular) cells. A typical example is the blood brain barrier.

In the present invention, the term "blood brain barrier" or BBB is a barrier formed by tight junctions in the capillary endothelial membrane of the brain existing between the brain and spine and its surrounding circulatory system. This barrier is so sturdy that it also limits the passage of molecules having low molecular weight of about 60 Da to the brain. The blood brain barrier of the brain, the vascular spinal cord barrier of the spine and the vascular retinal barrier of the retina are continuous capillary barriers in the central nervous system, commonly referred to as BBB.

In the present invention, a "blood brain barrier transporter" may pass through the blood brain barrier and deliver an antibody or an antigen-binding fragment thereof according to the present invention, and for example, include a protein including g peptide and polypeptide, a nucleic acid, an antibody, or a small molecular compound.

The antibodies of the present invention can be generated and selected from transgenic mice, e.g., those described above, where the mice is introduced by the gene encoding the antigen-specific human mAbs having the desired specificity using hybridoma technology. Such antibodies can be cloned and expressed using appropriate vectors and host cells, or the antibodies can be harvested from cultured hybridoma cells. In addition, the antibody may be derived from a phage-display library. Phage display technology is a method that mimics a sort of immune selection by selecting an antibody repertoire on the surface of a filamentous bacteriophage and selecting phage binding to a desired antigen therefrom. Such a technique may refer to an embodiment of the present invention or PCT Publication No. WO 1999/010494. In an embodiment, the humanized IGF1R antibody of the present invention is selected through a phage display method.

The present invention relates to an isolated antibody or antigen-binding fragment that specifically binds to IGF1R, wherein the antibody or antigen-binding fragment can be a polypeptide, protein, antibody or its antigen-binding fragment specifically binding to IGF1R including the complementarity determining regions of the heavy chain and the complementarity determining regions of the light chain.

Specifically, it is described below for antibodies that specifically bind to IGF1R.

The anti-IGF1R antibody or antigen-binding fragment of the present invention specifically recognizes IGF1R (Insulin-like Growth Factor 1 Receptor), recognizes and binds to IGF1R, particularly human IGF1R, mouse IGF1R, rat IGF1R, and monkey IGF1R, does not interfere with the binding of IGF1R, IGF-1R, IGF-2, and/or insulin to IGF1R and inhibit the signal transduction through IGF1R, and can be used for transcytosis to pass through the barrier in blood. It does not have antibody-dependent cell-mediated cytotoxicity (ADCC) and does not decrease IGF1R levels in the brain even when administered to animals repeatedly.

In particular, the anti-IGF1R antibody of the present invention binds to IGF1R located on the surface of brain endothelial cells constituting BBB and internalizes into the inner part of the cell. For example, whether the anti-IGF1R antibody of the present invention is internalized into cells can be identified by using a cell line expressing IGF1R (e.g., MCF-7). Anti-IGF1R antibodies of the present invention, e.g., 1564, 48G5, 54H4, 60H6, B11 and affinity variants of 1564 such as C04, F06, VH2, VH5, VH7, VH9, VH16, VH32 and VH35 have a higher internalization degree compared to the negative control. The results suggest that the internalization degree of the tested anti-IGF1R antibodies is specific to IGF1R on the cell surface. In addition, the anti-IGF1R antibody of the present invention is in scFv form, and can be produced as being linked to a therapeutic antibody in various ways. For example, the scFv of an anti-IGF1R antibody can be prepared in a bispecific antibody, for example a bivalent form of a bispecific antibody in which two scFvs bind to C-terminus of therapeutic antibody, for example, α-syn antibody, or a monovalent form of a bispecific antibody in which one scFv binds to C-terminus of therapeutic antibody. The bispecific antibodies can internalize into the cells expressing IGF1R. The IGF1R antibody has a high binding capacity to the antigen on the cell surface, which enhances the internalization effect and leads to BBB-passing ability. However, if the antibody has the ability to pass the BBB and interferes with the signaling of IGF1R, it can cause side effects. The antibody of the present invention is characterized in both the binding capacity suitable for a BBB shuttle and the non-blocking property for IGF1R signaling.

The present invention relates to an isolated antibody or antigen-binding fragment that specifically binds to IGF1R, wherein the antibody or antigen-binding fragment can be a polypeptide, protein or antibody specifically binding to IGF1R including the complementarity determining regions of the heavy chain and the complementarity determining regions of the light chain.

In specific examples, the anti-IGF1R antibody or antigen-binding fragment thereof can include:
(i) one or more heavy chain complementarity determining regions selected from the group consisting of H-CDR1, H-CDR2 and H-CDR3 described in Table 1, or a heavy chain variable region comprising the one or more heavy chain complementarity determining regions;
(ii) one or more light chain complementarity determining regions selected from the group consisting of L-CDR1, L-CDR2 and L-CDR3 described in Table 1, or a light chain variable region comprising the one or more light chain complementarity determining regions;
a combination of one or more heavy chain complementarity determining regions (CDRs) and one or more light chain complementarity determining regions (CDRs); or
a combination of the heavy chain variable region and the light chain variable region.

Additionally, in the heavy chain variable region, the light chain variable region, or a combination of the heavy chain variable region and the light chain variable region, the heavy chain variable region may include one or more heavy chain framework regions selected from the group consisting of H-FR1, H-FR2, H-FR3 and H-FR4, and the light chain variable region may include one or more light chain framework regions selected from the group consisting of L-FR1, L-FR2, L-FR3, and L-FR4.

(i) H-CDR1, H-CDR2 or H-CDR3 of heavy chain CDR of the present invention is selected from the amino acid sequences listed in Table 1 or comprises at least one amino acid sequence having substantial sequence identity with the selected amino acid sequence. In addition,
(ii) L-CDR1, L-CDR2 or L-CDR3 of the light chain CDR is selected from the amino acid sequences listed in Table 2 or comprises one or more amino acid sequences having substantial sequence identity with the selected amino acid sequence.

"Substantial sequence identity" means that the sequence includes the variation but maintains the effects disclosed in the present invention. The sequence has about 90%, 95%, or 99% of identity to the heavy chain variable region disclosed in one embodiment. The sequence has about 90%, 9500, or 9900 of identity to the light chain variable region disclosed in other embodiments. For example, in the case of a variant showing about 90%, 9500 or 9900 identity to the sequence of the antibody or antigen-binding fragment disclosed in the present invention, any sequence variation occurs in the framework region of the variable region rather than the CDR.

TABLE 1

CDR sequences of the heavy chain variable region in the antibody clone of the present invention

| Clone ID | CDR-H1 | SEQ ID NO | CDR-H2 | SEQ ID NO | CDR-H3 | SEQ ID NO |
|---|---|---|---|---|---|---|
| 996-1 | GFTFSSYDMS | 1 | GIYHDGSSTYYADSVKG | 10 | VSGTLSEPYAFFFNAMDV | 50 |
| 996-2 | GFTFSSYDMS | 1 | GIYHDGSSTYYADSVKG | 10 | VSGTLSEPYAFFFNAMDV | 50 |
| 1226-1 | GFTFSNYDMS | 2 | SISPDGGSKYYADSVKG | 11 | DGGTHWLSLFDY | 51 |
| 1226-2 | GFTFSNYDMS | 2 | SISPDGGSKYYADSVKG | 11 | DGGTHWLSLFDY | 51 |
| 1564-1 | GFTFSSYDMS | 1 | AISYDNGNTYYADSVKG | 12 | GVLTTLMNWFDY | 52 |
| 1564-2 | GFTFSSYDMS | 1 | AISYDNGNTYYADSVKG | 12 | GVLTTLMNWFDY | 52 |
| 1564-3P | GFTFSSYDMS | 1 | AISYDNGNTYYADSVKG | 12 | GVLTTLMNWFDY | 52 |
| 1564-DM | GFTFSSYDMS | 1 | AISYDQGNTYYADSVKG | 13 | GVLTTLMNWFDY | 52 |
| 1564-DMP | GFTFSSYDMS | 1 | AISYDQGNTYYADSVKG | 13 | GVLTTLMNWFDY | 52 |
| 48G5-1 | GFTFSDYDMS | 3 | SIYPNGSSKYYADSVKG | 14 | AGINCTTLRCSSYDAMDV | 53 |
| 48G5-2 | GFTFSDYDMS | 3 | SIYPNGSSKYYADSVKG | 14 | AGINCTTLRCSSYDAMDV | 53 |
| 49G11-1 | GFTFSSYDMS | 1 | GISYSGGSTYYADSVKG | 15 | VGLACTPHTCSSYDAMDV | 54 |
| 49G11-2 | GFTFSSYDMS | 1 | GISYSGGSTYYADSVKG | 15 | VGLACTPHTCSSYDAMDV | 54 |
| 54H4-1 | GFTFSDYDMS | 3 | AISSDGSSAYYADSVKG | 16 | ATIYTSDAPWSSYDAMDV | 55 |
| 54H4-2 | GFTFSDYDMS | 3 | AISSDGSSAYYADSVKG | 16 | ATIYTSDAPWSSYDAMDV | 55 |
| 60A11-1 | GFTFSNYDMS | 2 | VISHSSSGTYYADSVKG | 17 | VGVACGETDCSSYDAMDV | 56 |
| 60A11-2 | GFTFSNYDMS | 2 | VISHSSSGTYYADSVKG | 17 | VGVACGETDCSSYDAMDV | 56 |
| 60H6-1 | GFTFSDYDMS | 3 | MIYSGSSSKYYADSVKG | 18 | ASIACTLQACSYDNAMDV | 57 |
| 60H6-2 | GFTFSDYDMS | 3 | MIYSGSSSKYYADSVKG | 18 | ASIACTLQACSYDNAMDV | 57 |
| 60H6-3P | GFTFSDYDMS | 3 | MIYSGSSSKYYADSVKG | 18 | ASIACTLQACSYDNAMDV | 57 |
| A1_ompseq | GFTFSSYDMS | 1 | AIYHDGGNTYYADSVKG | 19 | AASPCNVHDCSYDYAMDV | 58 |
| A3_ompseq | GFTFSDYDMS | 3 | GISYNGGSKYYADSVKG | 20 | VGIMCSETGCSYDNAMDV | 59 |
| A6_ompseq | GFTFSDYYMS | 4 | GISSDGGSIYYADSVKG | 21 | YASPTWLHILYYSDAMDV | 60 |
| A8_ompseq | GFTFSNYDMS | 2 | MIYSGSSSKYYADSVKG | 18 | ALIPCTPEGCYSYDAMDV | 61 |
| A10_ompseq | GFTFSGYAMS | 5 | AISSDGGSTYYADSVKG | 22 | DPWFSRWTAFDY | 62 |
| A12_ompseq | GFTFSDYDMS | 3 | GIYPDGGNIYYADSVKG | 23 | GIGQCELRECSSDDGMDV | 63 |
| B5_ompseq | GFTFSDYDMS | 3 | AIYDSGSIYYADSVKG | 24 | AVSECNPLNCSYSDAMDV | 64 |
| B9_ompseq | GFTFSDYDMS | 3 | MIYSGSSKYYADSVKG | 18 | VILGCSKHSCPSSDAMDV | 65 |
| B11_ompseq | GFTFSDYDMS | 3 | AISYDNGNKYYADSVKG | 25 | AGVACTEHMCSSYDAMDV | 66 |
| C2_ompseq | GFTFSSYDMS | 1 | LIYPGGGNIYYADSVKG | 26 | GRVPCHPGGCSYAYGMDV | 67 |
| C6_ompseq | GFTFSNYAMS | 6 | WISSGGGSTYYADSVKG | 27 | LGSLFPNATASYAYGMDV | 68 |
| C7_ompseq | GFTFSNYDMS | 2 | SISYDSGSKYYADSVKG | 28 | AGILCTPTHCSSYDAMDV | 69 |
| C11_ompseq | GFTFSDYAMS | 7 | SIYPDDGNTYYADSVKG | 29 | DGWTPDGTHFDY | 70 |

TABLE 1-continued

CDR sequences of the heavy chain variable region in the antibody clone of the present invention

| Clone ID | CDR-H1 | SEQ ID NO | CDR-H2 | SEQ ID NO | CDR-H3 | SEQ ID NO |
|---|---|---|---|---|---|---|
| D4_ompseq | GFTFSDYDMS | 3 | WISHSSSGTYYADSVKG | 30 | VGLSCAETACSSYDAMDV | 71 |
| E6_ompseq | GFTFSSYDMS | 1 | AISYDNGNTYYADSVKG | 12 | VGLDCDTTKCSSYDAMDV | 72 |
| E10_ompseq | GFTFSNYDMS | 2 | VISHSSSGTYYADSVKG | 17 | VGVACGETDCSSYDAMDV | 56 |
| E12_ompseq | GFTFSDYDMS | 3 | WISHSSSGTYYADSVKG | 30 | VGLSCAETACSSYDAMDV | 71 |
| F6_ompseq | GFTFSDYDMS | 3 | MIYSGSSSKYYADSVKG | 18 | AVRPCTDLHCSSDDAMDV | 73 |
| F11_ompseq | GFTFSDYDMS | 3 | AISYDSGSKYYADSVKG | 31 | VGRMCNITHCSSYDAMDV | 74 |
| F12_ompseq | GFTFSDYDMS | 3 | SIYYGSGNIYYADSVKG | 32 | DLTAPDGSSFDY | 75 |
| G9_ompseq | GFTFSSYDMS | 1 | AISYDNGSSIYYADSVKG | 33 | VGLECTVEHCYSYDGMDV | 76 |
| C04-1 | GFTFSSYDMS | 1 | AISYDNGNTYYADSVKG | 12 | GVLTTLMNWFDY | 52 |
| C04-2 | GFTFSSYDMS | 1 | AISYDNGNTYYADSVKG | 12 | GVLTTLMNWFDY | 52 |
| C04-3P | GFTFSSYDMS | 1 | AISYDNGNTYYADSVKG | 12 | GVLTTLMNWFDY | 52 |
| C04-DM | GFTFSSYDMS | 1 | AISYDQGNTYYADSVKG | 13 | GVLTTLMNWFDY | 52 |
| C04-DMP | GFTFSSYDMS | 1 | AISYDQGNTYYADSVKG | 13 | GVLTTLMNWFDY | 52 |
| F06-1 | GFTFSSYDMS | 1 | AISYDNGNTYYADSVKG | 12 | GVLTTLMNWFDY | 52 |
| F06-2 | GFTFSSYDMS | 1 | AISYDNGNTYYADSVKG | 12 | GVLTTLMNWFDY | 52 |
| F06-3P | GFTFSSYDMS | 1 | AISYDNGNTYYADSVKG | 12 | GVLTTLMNWFDY | 52 |
| F06-DM | GFTFSSYDMS | 1 | AISYDQGNTYYADSVKG | 13 | GVLTTLMNWFDY | 52 |
| F06-DMP | GFTFSSYDMS | 1 | AISYDQGNTYYADSVKG | 13 | GVLTTLMNWFDY | 52 |
| B01 | GFTFSSYDMS | 1 | AISWDKAQPYYADSVKG | 34 | GVLTTLMNWFDY | 52 |
| A07(AR) | GFTFSSYDMS | 1 | AISWDQGNSYYADSVKG | 35 | GVLTTLMNWFDY | 52 |
| E09 | GFTFSSYDMS | 1 | AISWGQGKTYYADSVKG | 36 | GVLTTLMNWFDY | 52 |
| D03 | GFTFSSYDMS | 1 | AISYDNGQTYYADSVKG | 37 | GVLTTLMNWFDY | 52 |
| A02 | GFTFSSYDMS | 1 | AISYDNGNTYYADSVKG | 12 | GVLTTLMNWFDY | 52 |
| B09 | GFTFSSYDMS | 1 | AISYDNGNTYYADSVKG | 12 | GVLTTLMNWFDY | 52 |
| B10 | GFTFSSYDMS | 1 | AISYDNGNTYYADSVKG | 12 | GVLTTLMNWFDY | 52 |
| E06 | GFTFSSYDMS | 1 | AISYDNGNTYYADSVKG | 12 | GVLTTLMNWFDY | 52 |
| H04 | GFTFSSYDMS | 1 | AISYDNGNTYYADSVKG | 12 | GVLTTLMNWFDY | 52 |
| A06 | GFTFSSYDMS | 1 | AISYDNGNTYYADSVKG | 12 | GVLTTLMNWFDY | 52 |
| A07(AM) | GFTFSSYDMS | 1 | AISYDNGNTYYADSVKG | 12 | GVLTTLMNWFDY | 52 |
| B02 | GFTFSSYDMS | 1 | AISYDNGNTYYADSVKG | 12 | GVLTTLMNWFDY | 52 |
| VH02-1 | GFTFSSYAMS | 8 | AISGSNGNTYYADSVKG | 38 | GVLTTLANWFDY | 77 |
| VH02-2 | GFTFSSYAMS | 8 | AISGSNGNTYYADSVKG | 38 | GVLTTLANWFDY | 77 |
| VH02-3P | GFTFSSYAMS | 8 | AISGSNGNTYYADSVKG | 38 | GVLTTLANWFDY | 77 |
| VH02-DM | GFTFSSYAMS | 8 | AISGSQGNTYYADSVKG | 39 | GVLTTLANWFDY | 77 |
| VH02-DMP | GFTFSSYAMS | 8 | AISGSQGNTYYADSVKG | 39 | GVLTTLANWFDY | 77 |
| VH05-1 | GFTFSSYDMS | 1 | AISGDNGSTYYADSVKG | 40 | GVLTTLMNWFDS | 78 |
| VH05-2 | GFTFSSYDMS | 1 | AISGDNGSTYYADSVKG | 40 | GVLTTLMNWFDS | 78 |
| VH05-3P | GFTFSSYDMS | 1 | AISGDNGSTYYADSVKG | 40 | GVLTTLMNWFDS | 78 |
| VH05-DM | GFTFSSYDMS | 1 | AISGDQGSTYYADSVKG | 41 | GVLTTLMNWFDS | 78 |
| VH05-DMP | GFTFSSYDMS | 1 | AISGDQGSTYYADSVKG | 41 | GVLTTLMNWFDS | 78 |
| VH06-1 | GFTFSSYDMS | 1 | AISYSNGNTYYADSVKG | 42 | GVLTTLANWFDY | 77 |
| VH06-2 | GFTFSSYDMS | 1 | AISYSNGNTYYADSVKG | 42 | GVLTTLANWFDY | 77 |
| VH06-3P | GFTFSSYDMS | 1 | AISYSNGNTYYADSVKG | 42 | GVLTTLANWFDY | 77 |
| VH06-DM | GFTFSSYDMS | 1 | AISYSQGNTYYADSVKG | 43 | GVLTTLANWFDY | 77 |
| VH06-DMP | GFTFSSYDMS | 1 | AISYSQGNTYYADSVKG | 43 | GVLTTLANWFDY | 77 |
| VH07-1 | GFTFSSYAMS | 8 | AISYDNGSTYYADSVKG | 44 | GVLTTLMNWFDY | 52 |
| VH07-2 | GFTFSSYAMS | 8 | AISYDNGSTYYADSVKG | 44 | GVLTTLMNWFDY | 52 |
| VH07-3 | GFTFSSYAMS | 8 | AISYDNGSTYYADSVKG | 44 | GVLTTLMNWFDY | 52 |
| VH07-DM | GFTFSSYAMS | 8 | AISYDQGSTYYADSVKG | 45 | GVLTTLMNWFDY | 52 |
| VH07-DMP | GFTFSSYAMS | 8 | AISYDQGSTYYADSVKG | 45 | GVLTTLMNWFDY | 52 |
| VH09-1 | GFTFSSYDMS | 1 | AISGDNGNTYYADSVKG | 46 | GVLTTLMNWFDY | 52 |
| VH09-2 | GFTFSSYDMS | 1 | AISGDNGNTYYADSVKG | 46 | GVLTTLMNWFDY | 52 |
| VH09-3P | GFTFSSYDMS | 1 | AISGDNGNTYYADSVKG | 46 | GVLTTLMNWFDY | 52 |
| VH09-DM | GFTFSSYDMS | 1 | AISGDQGNTYYADSVKG | 47 | GVLTTLMNWFDY | 52 |
| VH09-DMP | GFTFSSYDMS | 1 | AISGDQGNTYYADSVKG | 47 | GVLTTLMNWFDY | 52 |
| VH16-1 | GFTFSSYDMS | 1 | AISGSNGNTYYADSVKG | 38 | GVLTTLMNWFDY | 52 |
| VH16-2 | GFTFSSYDMS | 1 | AISGSNGNTYYADSVKG | 38 | GVLTTLMNWFDY | 52 |
| VH16-3P | GFTFSSYDMS | 1 | AISGSNGNTYYADSVKG | 38 | GVLTTLMNWFDY | 52 |
| VH16-DM | GFTFSSYDMS | 1 | AISGSQGNTYYADSVKG | 39 | GVLTTLMNWFDY | 52 |
| VH16-DMP | GFTFSSYDMS | 1 | AISGSQGNTYYADSVKG | 39 | GVLTTLMNWFDY | 52 |
| VH27-1 | GFTFSSYAMS | 8 | AISYDNGSTYYADSVKG | 44 | GVLTTLMNWFDS | 78 |
| VH27-2 | GFTFSSYAMS | 8 | AISYDNGSTYYADSVKG | 44 | GVLTTLMNWFDS | 78 |
| VH27-3P | GFTFSSYAMS | 8 | AISYDNGSTYYADSVKG | 44 | GVLTTLMNWFDS | 78 |
| VH27-DM | GFTFSSYAMS | 8 | AISYDQGSTYYADSVKG | 45 | GVLTTLMNWFDS | 78 |
| VH27-DMP | GFTFSSYAMS | 8 | AISYDQGSTYYADSVKG | 45 | GVLTTLMNWFDS | 78 |
| VH32-1 | GFTFSSYAMS | 8 | AISYDNGNTYYADSVKG | 12 | GVLTTLANWFDY | 77 |
| VH32-2 | GFTFSSYAMS | 8 | AISYDNGNTYYADSVKG | 12 | GVLTTLANWFDY | 77 |
| VH32-3 | GFTFSSYAMS | 8 | AISYDNGNTYYADSVKG | 12 | GVLTTLANWFDY | 77 |
| VH32-DM | GFTFSSYAMS | 8 | AISYDQGNTYYADSVKG | 13 | GVLTTLANWFDY | 77 |
| VH32-DMP | GFTFSSYAMS | 8 | AISYDQGNTYYADSVKG | 13 | GVLTTLANWFDY | 77 |
| VH35-1 | GFTFSSYDMS | 1 | AISYDNGSTYYADSVKG | 44 | GVLTTLMNWFDS | 78 |
| VH35-2 | GFTFSSYDMS | 1 | AISYDNGSTYYADSVKG | 44 | GVLTTLMNWFDS | 78 |
| VH35-3 | GFTFSSYDMS | 1 | AISYDNGSTYYADSVKG | 44 | GVLTTLMNWFDS | 78 |
| VH35-DM | GFTFSSYDMS | 1 | AISYDQGSTYYADSVKG | 45 | GVLTTLMNWFDS | 78 |
| VH35-DMP | GFTFSSYDMS | 1 | AISYDQGSTYYADSVKG | 45 | GVLTTLMNWFDS | 78 |

TABLE 1-continued

CDR sequences of the heavy chain variable region in the antibody clone of the present invention

| Clone ID | CDR-H1 | SEQ ID NO | CDR-H2 | SEQ ID NO | CDR-H3 | SEQ ID NO |
|---|---|---|---|---|---|---|
| VH48 | GFTFSSYAMS | 8 | AISGSNGNTYYADSVKG | 38 | GVLTTLANWFDS | 79 |
| VH55 | GFTFSSYDMS | 1 | AISYDNGNTYYADSVKG | 12 | GVLTTLANWFDY | 77 |
| VH81 | GFTFSSYDMS | 1 | AISGSNGSTYYADSVKG | 48 | GVLTTLMNWFDY | 52 |
| C12 | GFTFICPILS | 9 | AISYDNGNTYYADSVKG | 12 | GVLTTLMCLRHL | 80 |
| 1564-VL(N51D) | GFTFSSYDMS | 1 | AISYDNGNTYYADSVKG | 12 | GVLTTLMNWFDY | 52 |
| 1564-VL(N95aD) | GFTFSSYDMS | 1 | AISYDNGNTYYADSVKG | 12 | GVLTTLMNWFDY | 52 |
| 1564-VL(N95aH) | GFTFSSYDMS | 1 | AISYDNGNTYYADSVKG | 12 | GVLTTLMNWFDY | 52 |
| 1564-VL(N95aK) | GFTFSSYDMS | 1 | AISYDNGNTYYADSVKG | 12 | GVLTTLMNWFDY | 52 |
| 1564-VL(N95aR) | GFTFSSYDMS | 1 | AISYDNGNTYYADSVKG | 12 | GVLTTLMNWFDY | 52 |
| 1564-VH(N54D) | GFTFSSYDMS | 1 | AISYDDGNTYYADSVKG | 49 | GVLTTLMNWFDY | 52 |
| 1564-VH(N54Q) | GFTFSSYDMS | 1 | AISYDQGNTYYADSVKG | 13 | GVLTTLMNWFDY | 52 |

TABLE 2

CDR sequences of the light chain variable region in the antibody clone of the present invention

| Clone ID | CDR-L1 | SEQ ID NO | CDR-L2 | SEQ ID NO | CDR-L3 | SEQ ID NO |
|---|---|---|---|---|---|---|
| 996-1 | TGSSSNIGSNAVN | 96 | SNSHRPS | 114 | ATWDYSLSGYV | 133 |
| 996-2 | TGSSSNIGSNAVN | 96 | SNSHRPS | 114 | ATWDYSLSGYV | 133 |
| 1226-1 | TGSSSNIGNNTVS | 97 | YDNHRPS | 115 | GSWDASLNGYV | 134 |
| 1226-2 | TGSSSNIGNNTVS | 97 | YDNHRPS | 115 | GSWDASLNGYV | 134 |
| 1564-1 | TGSSSNIGSNDVS | 98 | ANSNRPS | 116 | GAWDDSLNGYV | 135 |
| 1564-2 | TGSSSNIGSNDVS | 98 | ANSNRPS | 116 | GAWDDSLNGYV | 135 |
| 1564-3 | TGSSSNIGSNDVS | 98 | ANSNRPS | 116 | GAWDDSLNGYV | 135 |
| 1564-DM | TGSSSNIGSNDVS | 98 | AQSNRPS | 117 | GAWDDSLHGYV | 136 |
| 1564-DMP | TGSSSNIGSNDVS | 98 | AQSNRPS | 117 | GAWDDSLHGYV | 136 |
| 48G5-1 | SGSSSNIGNNDVS | 99 | DNNHRPS | 118 | AAWDDSLNAYV | 137 |
| 48G5-2 | SGSSSNIGNNDVS | 99 | DNNHRPS | 118 | AAWDDSLNAYV | 137 |
| 49G11-1 | TGSSSNIGSNTVY | 100 | SDSNRPS | 119 | GTWDDSLNGYV | 138 |
| 49G11-2 | TGSSSNIGSNTVY | 100 | SDSNRPS | 119 | GTWDDSLNGYV | 138 |
| 54H4-1 | SGSSSNIGSNTVT | 101 | ADSKRPS | 120 | GTWDDSLNAYV | 139 |
| 54H4-2 | SGSSSNIGSNTVT | 101 | ADSKRPS | 120 | GTWDDSLNAYV | 139 |
| 60A11-1 | SGSSSNIGSNAVT | 102 | DDNHRPS | 121 | GAWDDSLNGYV | 135 |
| 60A11-2 | SGSSSNIGSNAVT | 102 | DDNHRPS | 121 | GAWDDSLNGYV | 135 |
| 60H6-1 | TGSSSNIGNNDVS | 103 | ANSHRPS | 122 | GSWDDSLNGYV | 140 |
| 60H6-2 | TGSSSNIGNNDVS | 103 | ANSHRPS | 122 | GSWDDSLNGYV | 140 |
| 60H6-3 | TGSSSNIGNNDVS | 103 | ANSHRPS | 122 | GSWDDSLNGYV | 140 |
| A1_ompseq | SGSSSNIGNNAVT | 104 | DDSQRPS | 123 | GSWDDSLNGYV | 140 |
| A3_ompseq | SGSSSNIGNNDVD | 105 | YDSQRPS | 124 | GTWDDSLNAYV | 139 |
| A6_ompseq | SGSSSNIGNNAVT | 104 | DDSHRPS | 125 | GSWDSSLNGYV | 141 |
| A8_ompseq | TGSSSNIGNNDVS | 103 | DDSKRPS | 126 | GAWDDSLNGYV | 135 |
| A10_ompseq | SGSSSNIGNNAVN | 106 | SNSKRPS | 127 | GTWDYSLSGYV | 142 |
| A12_ompseq | TGSSSNIGNNDVN | 107 | SNSHRPS | 114 | GTWDDSLNGYV | 138 |
| B5_ompseq | SGSSSNIGNNDVS | 99 | DDNQRPS | 128 | ATWDASLNGYV | 143 |
| B9_ompseq | SGSSSNIGNNNVT | 108 | DDSQRPS | 123 | GSWDDSLNGYV | 140 |
| B11_ompseq | SGSSSNIGNNDVS | 99 | DDNHRPS | 121 | GAWDYSLSGYV | 144 |
| C2_ompseq | SGSSFNIGSNDVS | 109 | DNSKRPS | 129 | GTWDDSLNGYV | 138 |
| C6_ompseq | SGSSSNIGSNDVS | 110 | DNSQRPS | 648 | GSWDASLNAYV | 145 |
| C7_ompseq | SGSSSNIGNNDVN | 111 | SNSHRPS | 114 | GTWDDSLNGYV | 138 |
| C11_ompseq | SGSSSNIGNNDVS | 99 | SNSHRPS | 114 | GSWDASLNGYV | 134 |
| D4_ompseq | SGSSSNIGSNDVS | 110 | DDSNRPS | 130 | GSWDDSLNGYV | 140 |
| E6_ompseq | SGSSSNIGNNDVN | 111 | SNSHRPS | 114 | GAWDYSLSAYV | 146 |
| E10_ompseq | SGSSSNIGSNAVT | 102 | DDNHRPS | 121 | GAWDDSLNGYV | 135 |
| E12_ompseq | SGSSSNIGSNDVS | 110 | DDSNRPS | 130 | GSWDDSLNGYV | 140 |
| F6_ompseq | SGSSSNIGNNDVS | 99 | DNNHRPS | 118 | AAWDDSLNAYV | 137 |
| F11_ompseq | TGSSSNIGSNYVS | 112 | DDSHRPS | 125 | GAWDDSLNGYV | 135 |
| F12_ompseq | TGSSSNIGNNDVS | 103 | SDSQRPS | 131 | GAWDASLNGYV | 147 |
| G9_ompseq | TGSSSNIGSNTVN | 113 | DNSQRPS | 648 | ASWDDSLNAYV | 148 |
| C04-1 | TGSSSNIGSNDVS | 98 | ANSNRPS | 116 | GAWEQWLNGYV | 149 |
| C04-2 | TGSSSNIGSNDVS | 98 | ANSNRPS | 116 | GAWEQWLNGYV | 149 |
| C04-3 | TGSSSNIGSNDVS | 98 | ANSNRPS | 116 | GAWEQWLNGYV | 149 |
| C04-DM | TGSSSNIGSNDVS | 98 | AQSNRPS | 117 | GAWEQWLHGYV | 150 |
| C04-DMP | TGSSSNIGSNDVS | 98 | AQSNRPS | 117 | GAWEQWLHGYV | 150 |
| F06-1 | TGSSSNIGSNDVS | 98 | ANSNRPS | 116 | GTWAGSLNGYV | 151 |
| F06-2 | TGSSSNIGSNDVS | 98 | ANSNRPS | 116 | GTWAGSLNGYV | 151 |
| F06-3 | TGSSSNIGSNDVS | 98 | ANSNRPS | 116 | GTWAGSLNGYV | 151 |

TABLE 2-continued

CDR sequences of the light chain variable region in the antibody clone of the present invention

| Clone ID | CDR-L1 | SEQ ID NO | CDR-L2 | SEQ ID NO | CDR-L3 | SEQ ID NO |
|---|---|---|---|---|---|---|
| F06-DM | TGSSSNIGSNDVS | 98 | AQSNRPS | 117 | GTWAGSLHGYV | 152 |
| F06-DMP | TGSSSNIGSNDVS | 98 | AQSNRPS | 117 | GTWAGSLHGYV | 152 |
| B01 | TGSSSNIGSNDVS | 98 | ANSNRPS | 116 | GAWDDSLNGYV | 135 |
| A07(AR) | TGSSSNIGSNDVS | 98 | ANSNRPS | 116 | GAWDDSLNGYV | 135 |
| E09 | TGSSSNIGSNDVS | 98 | ANSNRPS | 116 | GAWDDSLNGYV | 135 |
| D03 | TGSSSNIGSNDVS | 98 | ANSNRPS | 116 | GAWDDSLNGYV | 135 |
| A02 | TGSSSNIGSNDVS | 98 | ANSNRPS | 116 | GAWDTTLNGYV | 153 |
| B09 | TGSSSNIGSNDVS | 98 | ANSNRPS | 116 | GAWEESLNGYV | 154 |
| B10 | TGSSSNIGSNDVS | 98 | ANSNRPS | 116 | GSWDVSLNGYV | 155 |
| E06 | TGSSSNIGSNDVS | 98 | ANSNRPS | 116 | GAWDHSLNGYV | 156 |
| H04 | TGSSSNIGSNDVS | 98 | ANSNRPS | 116 | GAWDQSLNGYV | 157 |
| A06 | TGSSSNIGSNDVS | 98 | ANSNRPS | 116 | GASWDEWLNGYV | 158 |
| A07(AM) | TGSSSNIGSNDVS | 98 | ANSNRPS | 116 | GAWDETLNGYV | 159 |
| B02 | TGSSSNIGSNDVS | 98 | ANSNRPS | 116 | GTWDDSLNGYV | 138 |
| VH02-1 | TGSSSNIGSNDVS | 98 | ANSNRPS | 116 | GAWDDSLNGYV | 135 |
| VH02-2 | TGSSSNIGSNDVS | 98 | ANSNRPS | 116 | GAWDDSLNGYV | 135 |
| VH02-3 | TGSSSNIGSNDVS | 98 | ANSNRPS | 116 | GAWDDSLNGYV | 135 |
| VH02-DM | TGSSSNIGSNDVS | 98 | AQSNRPS | 117 | GAWDDSLHGYV | 136 |
| VH02-DMP | TGSSSNIGSNDVS | 98 | AQSNRPS | 117 | GAWDDSLHGYV | 136 |
| VH05-1 | TGSSSNIGSNDVS | 98 | ANSNRPS | 116 | GAWDDSLNGYV | 135 |
| VH05-2 | TGSSSNIGSNDVS | 98 | ANSNRPS | 116 | GAWDDSLNGYV | 135 |
| VH05-3 | TGSSSNIGSNDVS | 98 | ANSNRPS | 116 | GAWDDSLNGYV | 135 |
| VH05-DM | TGSSSNIGSNDVS | 98 | AQSNRPS | 117 | GAWDDSLHGYV | 136 |
| VH05-DMP | TGSSSNIGSNDVS | 98 | AQSNRPS | 117 | GAWDDSLHGYV | 136 |
| VH06-1 | TGSSSNIGSNDVS | 98 | ANSNRPS | 116 | GAWDDSLNGYV | 135 |
| VH06-2 | TGSSSNIGSNDVS | 98 | ANSNRPS | 116 | GAWDDSLNGYV | 135 |
| VH06-3 | TGSSSNIGSNDVS | 98 | ANSNRPS | 116 | GAWDDSLNGYV | 135 |
| VH06-DM | TGSSSNIGSNDVS | 98 | AQSNRPS | 117 | GAWDDSLHGYV | 136 |
| VH06-DMP | TGSSSNIGSNDVS | 98 | AQSNRPS | 117 | GAWDDSLHGYV | 136 |
| VH07-1 | TGSSSNIGSNDVS | 98 | ANSNRPS | 116 | GAWDDSLNGYV | 135 |
| VH07-2 | TGSSSNIGSNDVS | 98 | ANSNRPS | 116 | GAWDDSLNGYV | 135 |
| VH07-3 | TGSSSNIGSNDVS | 98 | ANSNRPS | 116 | GAWDDSLNGYV | 135 |
| VH07-DM | TGSSSNIGSNDVS | 98 | AQSNRPS | 117 | GAWDDSLHGYV | 136 |
| VH07-DMP | TGSSSNIGSNDVS | 98 | AQSNRPS | 117 | GAWDDSLHGYV | 136 |
| VH09-1 | TGSSSNIGSNDVS | 98 | ANSNRPS | 116 | GAWDDSLNGYV | 135 |
| VH09-2 | TGSSSNIGSNDVS | 98 | ANSNRPS | 116 | GAWDDSLNGYV | 135 |
| VH09-3 | TGSSSNIGSNDVS | 98 | ANSNRPS | 116 | GAWDDSLNGYV | 135 |
| VH09-DM | TGSSSNIGSNDVS | 98 | AQSNRPS | 117 | GAWDDSLHGYV | 136 |
| VH09-DMP | TGSSSNIGSNDVS | 98 | AQSNRPS | 117 | GAWDDSLHGYV | 136 |
| VH16-1 | TGSSSNIGSNDVS | 98 | ANSNRPS | 116 | GAWDDSLNGYV | 135 |
| VH16-2 | TGSSSNIGSNDVS | 98 | ANSNRPS | 116 | GAWDDSLNGYV | 135 |
| VH16-3 | TGSSSNIGSNDVS | 98 | ANSNRPS | 116 | GAWDDSLNGYV | 135 |
| VH16-DM | TGSSSNIGSNDVS | 98 | AQSNRPS | 117 | GAWDDSLHGYV | 136 |
| VH16-DMP | TGSSSNIGSNDVS | 98 | AQSNRPS | 117 | GAWDDSLHGYV | 136 |
| VH27-1 | TGSSSNIGSNDVS | 98 | ANSNRPS | 116 | GAWDDSLNGYV | 135 |
| VH27-2 | TGSSSNIGSNDVS | 98 | ANSNRPS | 116 | GAWDDSLNGYV | 135 |
| VH27-3 | TGSSSNIGSNDVS | 98 | ANSNRPS | 116 | GAWDDSLNGYV | 135 |
| VH27-DM | TGSSSNIGSNDVS | 98 | AQSNRPS | 117 | GAWDDSLHGYV | 136 |
| VH27-DMP | TGSSSNIGSNDVS | 98 | AQSNRPS | 117 | GAWDDSLHGYV | 136 |
| VH32-1 | TGSSSNIGSNDVS | 98 | ANSNRPS | 116 | GAWDDSLNGYV | 135 |
| VH32-2 | TGSSSNIGSNDVS | 98 | ANSNRPS | 116 | GAWDDSLNGYV | 135 |
| VH32-3 | TGSSSNIGSNDVS | 98 | ANSNRPS | 116 | GAWDDSLNGYV | 135 |
| VH32-DM | TGSSSNIGSNDVS | 98 | AQSNRPS | 117 | GAWDDSLHGYV | 136 |
| VH32-DMP | TGSSSNIGSNDVS | 98 | AQSNRPS | 117 | GAWDDSLHGYV | 136 |
| VH35-1 | TGSSSNIGSNDVS | 98 | ANSNRPS | 116 | GAWDDSLNGYV | 135 |
| VH35-2 | TGSSSNIGSNDVS | 98 | ANSNRPS | 116 | GAWDDSLNGYV | 135 |
| VH35-3 | TGSSSNIGSNDVS | 98 | ANSNRPS | 116 | GAWDDSLNGYV | 135 |
| VH35-DM | TGSSSNIGSNDVS | 98 | AQSNRPS | 117 | GAWDDSLHGYV | 136 |
| VH35-DMP | TGSSSNIGSNDVS | 98 | AQSNRPS | 117 | GAWDDSLHGYV | 136 |
| VH48 | TGSSSNIGSNDVS | 98 | ANSNRPS | 116 | GAWDDSLNGYV | 135 |
| VH55 | TGSSSNIGSNDVS | 98 | ANSNRPS | 116 | GAWDDSLNGYV | 135 |
| VH81 | TGSSSNIGSNDVS | 98 | ANSNRPS | 116 | GAWDDSLNGYV | 135 |
| C12 | TGSSSNIGSNDVS | 98 | ANSNRPS | 116 | GAWDDSLNGYV | 135 |
| 1564-VL(N51D) | TGSSSNIGSNDVS | 98 | ADSNRPS | 132 | GAWDDSLNGYV | 135 |
| 1564-VL(N95aD) | TGSSSNIGSNDVS | 98 | ANSNRPS | 116 | GAWDDSLDGYV | 160 |
| 1564-VL(N95aH) | TGSSSNIGSNDVS | 98 | ANSNRPS | 116 | GAWDDSLHGYV | 136 |
| 1564-VL(N95aK) | TGSSSNIGSNDVS | 98 | ANSNRPS | 116 | GAWDDSLKGYV | 161 |
| 1564-VL(N95aR) | TGSSSNIGSNDVS | 98 | ANSNRPS | 116 | GAWDDSLRGYV | 650 |
| 1564-VH(N54D) | TGSSSNIGSNDVS | 98 | ANSNRPS | 116 | GAWDDSLNGYV | 135 |
| 1564-VH(N54Q) | TGSSSNIGSNDVS | 98 | ANSNRPS | 116 | GAWDDSLNGYV | 135 |

The heavy chain framework region selected from the group consisting of H-FR1, H-FR2, H-FR3 and H-FR4 of the present invention can be selected from the amino acid sequences of Table 3. The light chain framework region selected from the group consisting of L-FR1, L-FR2, L-FR3, and L-FR4 of the present invention can be selected from the amino acid sequences of Table 4.

Specifically, the heavy chain variable region of the anti-IGF1R antibody of the present invention includes H-CDR1, H-CDR2 and H-CDR3 described in Table 1, or additionally H-FR1, H-FR2, H-FR3 and H-FR4 shown in Table 3. The light chain variable region of the anti-IGF1R antibody of the present invention includes L-CDR1, L-CDR2 and L-CDR3 shown in Table 2, or additionally L-FR1, L-FR2, L-FR3 and L-FR4 shown in Table 4. In an embodiment of the present invention, the anti-IGF1R antibody or antigen-binding fragment thereof can include a heavy chain variable region comprising CDR-H1, CDR-H2 and CDR-H3 of each clone selected from the group consisting of the amino acid sequences of CDR-H1, CDR-H2 and CDR-H3 shown in Table 1, and the light chain variable region comprising CDR-L1, CDR-L2 and CDR-L3 of each clone selected from the group consisting of the amino acid sequences of CDR-L1, CDR-L2 and CDR-L3 shown in Table 2.

In one embodiment of the present invention, the amino acid modification, for example, removal of deamidation of the amino acid in the Fc region of the anti-IGF1R antibody, can increase pK of the antibody due to a decrease in blood clearance, without changing the binding capacity to ECD of the antigen IGF1R, and result in the extension of half-life. In one example, the amino acid position in which the deamidation is removed in the anti-IGF1R antibody may be N51D of light chain LCDR2, or N95aK, N95aH, N95aR or N95aD of light chain LCDR3, or N54D or N54Q of heavy chain HCDR2 in clone 1564.

TABLE 3

Framework sequences of the heavy chain variable region in the antibody clone of the present invention

| Clone ID | H-FR1 | SEQ ID NO | H-FR2 | SEQ ID NO | H-FR3 | SEQ ID NO | H-FR4 | SEQ ID NO |
|---|---|---|---|---|---|---|---|---|
| 996-1 | EVQLLESGGGLVQ PGGSLRLSCAAS | 81 | WVRQAPG KGLEWVS | 85 | RFTISRDNSKNTLYLQMN SLRAEDTAVYYCAK | 87 | WGQGT LVTVSS | 92 |
| 996-2 | EVQLLESGGGLVQ PGGSLRLSCAAS | 81 | WVRQAPG KCLEWVS | 86 | RFTISRDNSKNTLYLQMN SLRAEDTAVYYCAK | 87 | WGQGT LVTVSS | 92 |
| 1226-1 | EVQLLESGGGLVQ PGGSLRLSCAAS | 81 | WVRQAPG KGLEWVS | 85 | RFTISRDNSKNTLYLQMN SLRAEDTAVYYCAK | 88 | WGQGT LVTVSS | 92 |
| 1226-2 | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 1564-1 | EVQLLESGGGLVQ PGGSLRLSCAAS | 81 | WVRQAPG KGLEWVS | 85 | RFTISRDNSKNTLYLQMN SLRAEDTAVYYCAK | 88 | WGQGT LVTVSS | 92 |
| 1564-2 | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 1564-3P | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 1564-DM | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 1564-DMP | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 48G5-1 | EVQLLESGGGLVQ PGGSLRLSCAAS | 81 | WVRQAPG KGLEWVS | 85 | RFTISRDNSKNTLYLQMN SLRAEDTAVYYCAK | 88 | WGQGT LVTVSS | 92 |
| 48G5-2 | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 49G11-1 | EVQLLESGGGLVQ PGGSLRLSCAAS | 81 | WVRQAPG KGLEWVS | 85 | RFTISRDNSKNTLYLQMN SLRAEDTAVYYCAK | 88 | WGQGT LVTVSS | 92 |
| 49G11-2 | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |
| 54H4-1 | EVQLLESGGGLVQ PGGSLRLSCAAS | 81 | WVRQAPG KGLEWVS | 85 | RFTISRDNSKNTLYLQMN SLRAEDTAVYYCAK | 88 | WGQGT LVTVSS | 92 |
| 54H4-2 | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LATVSS | 93 |
| 60A11-1 | EVQLLESGGGLVQ PGGSLRLSCAAS | 81 | WVRQAPG KGLEWVS | 85 | RFTISRDNSKNTLYLQMN SLRAEDTAVYYCAK | 88 | WGQGT LVTVSS | 92 |
| 60A11-2 | EVQLLESGGGLVQ PGGSLRLSCAAS | 81 | WVRQAPG KCLEWVS | 86 | RFTISRDNSKNTLYLQMN SLRAEDTAVYYCAK | 88 | WGQGT LVTVSS | 92 |

TABLE 3-continued

Framework sequences of the heavy chain variable region in the antibody clone of the present invention

| Clone ID | H-FR1 | SEQ ID NO | H-FR2 | SEQ ID NO | H-FR3 | SEQ ID NO | H-FR4 | SEQ ID NO |
|---|---|---|---|---|---|---|---|---|
| 60H6-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| 60H6-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| 60H6-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| A1_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| A3_ompseq | EVQLLESGGGLVQTGGSLRLSCAAS | 82 | WVRQAPGKGLEWVS | 85 | RFTISRDNSKNTLYLQMNSLRAEDTAVYYCAK | 88 | WGQGTLVTVSS | 92 |
| A6_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| A8_ompseq | EVQLLESGGGLVQPGGSLRLSCAAS | 81 | WVRQAPGKGLEWVS | 85 | RFTISRDNSKNTLYLQMNSLRAEDTAVYYCAR | 89 | WGQGTLVTVSS | 92 |
| A10_ompseq | EVQLLESGGGLAQPGGSLRLSCAAS | 83 | WVRQAPGKGLEWVS | 85 | RFTISRDNSKNTLYLQMNSLRAEDTAVYYCAR | 89 | WGQGTLVTVSS | 92 |
| A12_ompseq | EVQLLESGGGLVQPGGSLRLSCAAS | 81 | WVRQAPGKGLEWVS | 85 | RFTISRDNSKNTLYLQMNSLRAEDTAVYYCAR | 89 | WGQGTLVTVSS | 92 |
| B5_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| B9_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| B11_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| C2_ompseq | EVQLLESGGGLVQPGGSLRLSCAAS | 81 | WVRQAPGKGLEWVS | 85 | RFTISRDNSKNTLYLQMNSLRAEDTAVYYCAR | 89 | WGQGTLVTVSS | 92 |
| C6_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| C7_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| C11_ompseq | EVQLLESGGGLVQTGGSLRLSCAAS | 82 | WVRQAPGKGLEWVS | 85 | RFTISRDNSKNTLYLQMNSLRAEDTAVYYCAK | 88 | WGQGTLVTVSS | 92 |
| D4_ompseq | EVQLLESGGGLVQPGGSLRLSCAAS | 81 | WVRQAPGKGLEWVS | 85 | RFTISRDNSKNTLYLQMNSLRAEDAAVYYCAK | 90 | WGQGTLVTVSS | 92 |
| E6_ompseq | EVQLLESGGGLVQPGGSLRLSCAAS | 81 | WVRQAPGKGLEWVS | 85 | RFTISRDNSKNTLYLQMNSLRAEDTAVYYCAR | 89 | WGQGTLVTVSS | 92 |
| E10_ompseq | EVQLLESGGGLVQPGGSLRLSCAAS | 81 | WVRQAPGKGLEWVS | 85 | RFTISRDNPKNTLYLQMNSLRAEDTAVYYCAK | 91 | WGQGTLVTVSS | 92 |
| E12_ompseq | EVQLLESGGGLVQPGGSLRLSCAAS | 81 | WVRQAPGKGLEWVS | 85 | RFTISRDNSKNTLYLQMNSLRAEDAAVYYCAK | 90 | WGQGTLVTVSS | 92 |
| F6_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| F11_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| F12_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTQVTVSS | 94 |
| G9_ompseq | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |

TABLE 3-continued

Framework sequences of the heavy chain variable region in the antibody clone of the present invention

| Clone ID | H-FR1 | SEQ ID NO | H-FR2 | SEQ ID NO | H-FR3 | SEQ ID NO | H-FR4 | SEQ ID NO |
|---|---|---|---|---|---|---|---|---|
| C04-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| C04-2 | EVQLLESGGGLVQPGGSLRLSCAAS | 81 | WVRQAPGKcLEWVS | 86 | RFTISRDNSKNTLYLQMNSLRAEDTAVYYCAK | 88 | WGQGTLVTVSS | 92 |
| C04-3P | EVQLLESGGGLVQPGGSLRLSCAAS | 81 | WVRQAPGKcLEWVS | 86 | RFTISRDNSKNTLYLQMNSLRAEDTAVYYCAK | 88 | WGQGTLVTVSS | 92 |
| C04-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| C04-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| F06-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| F06-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| F06-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| F06-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| F06-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| B01 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| A07(AR) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| E09 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| D03 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| A02 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| B09 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| B10 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| E06 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| H04 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| A06 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| A07(AM) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| B02 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH02-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH02-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |

TABLE 3-continued

Framework sequences of the heavy chain variable region in the antibody clone of the present invention

| Clone ID | H-FR1 | SEQ ID NO | H-FR2 | SEQ ID NO | H-FR3 | SEQ ID NO | H-FR4 | SEQ ID NO |
|---|---|---|---|---|---|---|---|---|
| VH02-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH02-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH02-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH05-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH05-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH05-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH05-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH05-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH06-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH06-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH06-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH06-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH06-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH07-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH07-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH07-3 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH07-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH07-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH09-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH09-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH09-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH09-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH09-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH16-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |

TABLE 3-continued

Framework sequences of the heavy chain variable region in the antibody clone of the present invention

| Clone ID | H-FR1 | SEQ ID NO | H-FR2 | SEQ ID NO | H-FR3 | SEQ ID NO | H-FR4 | SEQ ID NO |
|---|---|---|---|---|---|---|---|---|
| VH16-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH16-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH16-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH16-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH27-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH27-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH27-3P | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH27-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH27-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH32-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH32-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH32-3 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH32-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH32-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH35-1 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH35-2 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH35-3 | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH35-DM | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH35-DMP | EVQLLESGGGLVQPGGSLRLSCAAS | 81 | WVRQAPGKCLEWVS | 86 | RFTISRDNSKNTLYLQMNSLRAEDTAVYYCAK | 88 | WGQGTLVTVSS | 92 |
| VH48 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH55 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| VH81 | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| C12 | EVQLLESGGGLVQPGGSLRRSCAAS | 84 | WVRQAPGKGLEWVS | 85 | RFTISRDNSKNTLYLQMNSLRAEDTAVYYCAK | 88 | WGQGSLVTVSS | 95 |
| 1564-VL(N51D) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |

TABLE 3-continued

Framework sequences of the heavy chain variable region in the antibody clone of the present invention

| Clone ID | H-FR1 | SEQ ID NO | H-FR2 | SEQ ID NO | H-FR3 | SEQ ID NO | H-FR4 | SEQ ID NO |
|---|---|---|---|---|---|---|---|---|
| 1564-VL(N95aD) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| 1564-VL(N95aH) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| 1564-VL(N95aK) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| 1564-VL(N95aR) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| 1564-VH(N54D) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |
| 1564-VH(N54Q) | EVQLLESGGGLVQPGGSLRLSCAAS | 81 | WVRQAPGKGLEWVS | 85 | RFTISRDNSKNTLYLQMNSLRAEDTAVYYCAK | 88 | WGQGTLVTVSS | 92 |

TABLE 4

Framework sequences of the light chain variable region in the antibody clone of the present invention

| Clone ID | L-FR1 | SEQ ID NO: | L-FR2 | SEQ ID NO: | L-FR3 | SEQ ID NO: | LFR4 | SEQ ID NO: |
|---|---|---|---|---|---|---|---|---|
| 996-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 996-2 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 1226-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 1226-2 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 1564-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 1564-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| 1564-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 1564-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| 1564-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 48G5-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 48G5-2 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 49G11-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 49G11-2 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 54H4-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |

TABLE 4-continued

Framework sequences of the light chain variable region in the antibody clone of the present invention

| Clone ID | L-FR1 | SEQ ID NO: | L-FR2 | SEQ ID NO: | L-FR3 | SEQ ID NO: | LFR4 | SEQ ID NO: |
|---|---|---|---|---|---|---|---|---|
| 54H4-2 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 60A11-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 60A11-2 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| 60H6-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 60H6-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| 60H6-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| A1_ompseq | QSVLTQPPSASGTPGQRATISC | 162 | WYQQLPGTAPKLLIY | 165 | GVPDRFSGSKSGTSASLAISGLRSEDEADYYC | 166 | FGGGTKLTVL | 169 |
| A3_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| A6_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| A8_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| A10_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| A12_ompseq | QSVLTQPPSASGTPGQRVTISC | 162 | WYQQLPGTAPKLLIY | 165 | GVPDRFSGSKSGTSASLAISGLRSEDGADYYC | 168 | FGGGTKLTVL | 169 |
| B5_ompseq | QSVLTQPPSASGPPGQRVTISC | 162 | WYQQLPGTAPKLLIY | 165 | GVPDRFSGSKSGTSASLAISGLRSEDEADYYC | 166 | FGGGTKLTVL | 169 |
| B9_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| B11_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| C2_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| C6_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| C7_ompseq | QSVLTQPPSASGTPGQRVTISC | 162 | WYQQLPGTAPKLLIY | 165 | GVPDRFSGSKSGTSASLAISGLRSEDGADYYC | 168 | FGGGTKLTVL | 169 |
| C11_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| D4_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| E6_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| E10_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTFL | 171 |
| E12_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| F6_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |

TABLE 4-continued

Framework sequences of the light chain variable region in the antibody clone of the present invention

| Clone ID | L-FR1 | SEQ ID NO: | L-FR2 | SEQ ID NO: | L-FR3 | SEQ ID NO: | LFR4 | SEQ ID NO: |
|---|---|---|---|---|---|---|---|---|
| F11_ompseq | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| F12_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| G9_ompseq | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| C04-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| C04-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| C04-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| C04-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| C04-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| F06-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| F06-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| F06-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| F06-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| F06-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| B01 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| A07(AR) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| E09 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| D03 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| A02 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| B09 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| B10 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| E06 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| H04 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| A06 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| A07(AM) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |

TABLE 4-continued

Framework sequences of the light chain variable region in the antibody clone of the present invention

| Clone ID | L-FR1 | SEQ ID NO: | L-FR2 | SEQ ID NO: | L-FR3 | SEQ ID NO: | LFR4 | SEQ ID NO: |
|---|---|---|---|---|---|---|---|---|
| B02 | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| VH02-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH02-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH02-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH02-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH02-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH05-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH05-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH05-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH05-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH05-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH06-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH06-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH06-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH06-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH06-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH07-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH07-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH07-3 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH07-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH07-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH09-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH09-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH09-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |

TABLE 4-continued

Framework sequences of the light chain variable region in the antibody clone of the present invention

| Clone ID | L-FR1 | SEQ ID NO: | L-FR2 | SEQ ID NO: | L-FR3 | SEQ ID NO: | L-FR4 | SEQ ID NO: |
|---|---|---|---|---|---|---|---|---|
| VH09-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH09-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH16-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH16-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH16-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH16-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH16-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH27-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH27-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH27-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH27-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH27-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH32-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH32-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH32-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH32-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH32-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH35-1 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH35-2 | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH35-3 | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH35-DM | QSVLTQPPSASGTPGQRVTISC | 162 | WYQQLPGTAPKLLIY | 165 | GVSDRFSGSKSGTSASLAISGLRSEDEADYYC | 167 | FGCGTKLTVL | 170 |
| VH35-DMP | QSVLTQPPSASGTPGQRVTISC | 162 | WYQQLPGTAPKLLIY | 165 | GVPDRFSGSKSGTSASLAISGLRSEDEADYYC | 166 | FGCGTKLTVL | 170 |
| VH48 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| VH55 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |

TABLE 4-continued

Framework sequences of the light chain variable region in the antibody clone of the present invention

| Clone ID | L-FR1 | SEQ ID NO: | L-FR2 | SEQ ID NO: | L-FR3 | SEQ ID NO: | LFR4 | SEQ ID NO: |
|---|---|---|---|---|---|---|---|---|
| VH81 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| C12 | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 1564-VL(N51D) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| 1564-VL(N95aD) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| 1564-VL(N95aH) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| 1564-VL(N95aK) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| 1564-VL(N95aR) | QSVLTQPPSASGTPGQRVTISC | 162 | WYQQLPGTAPKLLIY | 165 | GVSDRFSGSKSGTSASLAISGLRSEDEADYYC | 167 | FGGGTKLTVL | 169 |
| 1564-VH(N54D) | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |
| 1564-VH(N54Q) | QSVLTQPPSASGTPGQRVTISC | 162 | WYQQLPGTAPKLLIY | 165 | GVPDRFSGSKSGTSASLAISGLRSEDEADYYC | 166 | FGGGTKLTVL | 169 |

The anti-IGF1R antibody of the present invention may be an antibody comprising a light chain variable region and a heavy chain variable region, and various heavy and light chain variable regions disclosed herein are shown in Tables 5 and 6, CDR1 to CDR3 and framework regions 1 to 4 of each clone are described as SEQ ID NO.

The heavy chain variable region and the light chain variable region described in Table 5 and Table 6 can be freely combined for the production of various types of antibodies. Table 5 and Table 6 show an example of the combination of the heavy chain variable region and the light chain variable region.

TABLE 5

Heavy chain variable region of the antibody of the present invention

| SEQ ID NO | Heavy chain (VH) | CDR-H1 | CDR-H2 | CDR-H3 | HFR1 | HFR2 | HFR3 | HFR4 |
|---|---|---|---|---|---|---|---|---|
| 172 | 996-1 | 1 | 10 | 50 | 81 | 85 | 87 | 92 |
| 173 | 996-2 | 1 | 10 | 50 | 81 | 86 | 87 | 92 |
| 174 | 1226-1 | 2 | 11 | 51 | 81 | 85 | 88 | 92 |
| 175 | 1226-2 | 2 | 11 | 51 | 81 | 86 | 88 | 92 |
| 176 | 1564-1 | 1 | 12 | 52 | 81 | 85 | 88 | 92 |
| 177 | 1564-2 | 1 | 12 | 52 | 81 | 86 | 88 | 92 |
| 178 | 1564-3 | 1 | 12 | 52 | 81 | 86 | 88 | 92 |
| 179 | 1564-DM | 1 | 13 | 52 | 81 | 86 | 88 | 92 |
| 180 | 1564-DMP | 1 | 13 | 52 | 81 | 86 | 88 | 92 |
| 181 | 48G5-1 | 3 | 14 | 53 | 81 | 85 | 88 | 92 |
| 182 | 48G5-2 | 3 | 14 | 53 | 81 | 86 | 88 | 92 |
| 183 | 49G11-1 | 1 | 15 | 54 | 81 | 85 | 88 | 92 |
| 184 | 49G11-2 | 1 | 15 | 54 | 81 | 86 | 88 | 92 |
| 185 | 54H4-1 | 3 | 16 | 55 | 81 | 85 | 88 | 92 |
| 186 | 54H4-2 | 3 | 16 | 55 | 81 | 86 | 88 | 93 |
| 187 | 60A11-1 | 2 | 17 | 56 | 81 | 85 | 88 | 92 |
| 188 | 60A11-2 | 2 | 17 | 56 | 81 | 86 | 88 | 92 |
| 189 | 60H6-1 | 3 | 18 | 57 | 81 | 85 | 88 | 92 |
| 190 | 60H6-2 | 3 | 18 | 57 | 81 | 86 | 88 | 92 |
| 191 | 60H6-3 | 3 | 18 | 57 | 81 | 86 | 88 | 92 |

TABLE 5-continued

Heavy chain variable region of the antibody of the present invention

| SEQ ID NO | Heavy chain (VH) | CDR-H1 | CDR-H2 | CDR-H3 | HFR1 | HFR2 | HFR3 | HFR4 |
|---|---|---|---|---|---|---|---|---|
| 192 | A1_OMPSEQ | 1 | 19 | 58 | 81 | 85 | 88 | 92 |
| 193 | A3_OMPSEQ | 3 | 20 | 59 | 82 | 85 | 88 | 92 |
| 194 | A6_OMPSEQ | 4 | 21 | 60 | 81 | 85 | 88 | 92 |
| 195 | A8_OMPSEQ | 2 | 18 | 61 | 81 | 85 | 89 | 92 |
| 196 | A10_OMPSEQ | 5 | 22 | 62 | 83 | 85 | 89 | 92 |
| 197 | A12_OMPSEQ | 3 | 23 | 63 | 81 | 85 | 89 | 92 |
| 198 | B5_OMPSEQ | 3 | 24 | 64 | 81 | 85 | 88 | 92 |
| 199 | B9_OMPSEQ | 3 | 18 | 65 | 81 | 85 | 88 | 92 |
| 200 | B11_OMPSEQ | 3 | 25 | 66 | 81 | 85 | 88 | 92 |
| 201 | C2_OMPSEQ | 1 | 26 | 67 | 81 | 85 | 89 | 92 |
| 202 | C6_OMPSEQ | 6 | 27 | 68 | 81 | 85 | 88 | 92 |
| 203 | C7_OMPSEQ | 2 | 28 | 69 | 81 | 85 | 88 | 92 |
| 204 | C11_OMPSEQ | 7 | 29 | 70 | 82 | 85 | 88 | 92 |
| 205 | D4_OMPSEQ | 3 | 30 | 71 | 81 | 85 | 90 | 92 |
| 206 | E06_OMPSEQ | 1 | 12 | 72 | 81 | 85 | 89 | 92 |
| 207 | E10_OMPSEQ | 2 | 17 | 56 | 81 | 85 | 91 | 92 |
| 208 | E12_OMPSEQ | 3 | 30 | 71 | 81 | 85 | 90 | 92 |
| 209 | F06_OMPSEQ | 3 | 18 | 73 | 81 | 85 | 88 | 92 |
| 210 | F11_OMPSEQ | 3 | 31 | 74 | 81 | 85 | 88 | 92 |
| 211 | F12_OMPSEQ | 3 | 32 | 75 | 81 | 85 | 88 | 94 |
| 212 | G9_OMPSEQ | 1 | 33 | 76 | 81 | 85 | 88 | 92 |
| 213 | C04-1 | 1 | 12 | 52 | 81 | 85 | 88 | 92 |
| 214 | C04-2 | 1 | 12 | 52 | 81 | 86 | 88 | 92 |
| 215 | C04-3 | 1 | 12 | 52 | 81 | 86 | 88 | 92 |
| 216 | C04-DM | 1 | 13 | 52 | 81 | 86 | 88 | 92 |
| 217 | C04-DMP | 1 | 13 | 52 | 81 | 86 | 88 | 92 |
| 218 | F06-1 | 1 | 12 | 52 | 81 | 85 | 88 | 92 |
| 219 | F06-2 | 1 | 12 | 52 | 81 | 86 | 88 | 92 |
| 220 | F06-3 | 1 | 12 | 52 | 81 | 86 | 88 | 92 |
| 221 | F06-DM | 1 | 13 | 52 | 81 | 86 | 88 | 92 |
| 222 | F06-DMP | 1 | 13 | 52 | 81 | 86 | 88 | 92 |
| 223 | B01 | 1 | 34 | 52 | 81 | 85 | 88 | 92 |
| 224 | A07(AR) | 1 | 35 | 52 | 81 | 85 | 88 | 92 |
| 225 | E09 | 1 | 36 | 52 | 81 | 85 | 88 | 92 |
| 226 | D03 | 1 | 37 | 52 | 81 | 85 | 88 | 92 |

TABLE 5-continued

Heavy chain variable region of the antibody of the present invention

| SEQ ID NO | Heavy chain (VH) | CDR-H1 | CDR-H2 | CDR-H3 | HFR1 | HFR2 | HFR3 | HFR4 |
|---|---|---|---|---|---|---|---|---|
| 227 | A02 | 1 | 12 | 52 | 81 | 85 | 88 | 92 |
| 228 | B09 | 1 | 12 | 52 | 81 | 85 | 88 | 92 |
| 229 | B10 | 1 | 12 | 52 | 81 | 85 | 88 | 92 |
| 230 | E06 | 1 | 12 | 52 | 81 | 85 | 88 | 92 |
| 231 | H04 | 1 | 12 | 52 | 81 | 85 | 88 | 92 |
| 232 | A06 | 1 | 12 | 52 | 81 | 85 | 88 | 92 |
| 233 | A07(AM) | 1 | 12 | 52 | 81 | 85 | 88 | 92 |
| 234 | B02 | 1 | 12 | 52 | 81 | 85 | 88 | 92 |
| 235 | VH2-1 | 8 | 38 | 77 | 81 | 85 | 88 | 92 |
| 236 | VH2-2 | 8 | 38 | 77 | 81 | 86 | 88 | 92 |
| 237 | VH2-3 | 8 | 38 | 77 | 81 | 86 | 88 | 92 |
| 238 | VH2-DM | 8 | 39 | 77 | 81 | 86 | 88 | 92 |
| 239 | VH2-DMP | 8 | 39 | 77 | 81 | 86 | 88 | 92 |
| 240 | VH5-1 | 1 | 40 | 78 | 81 | 85 | 88 | 92 |
| 241 | VH5-2 | 1 | 40 | 78 | 81 | 86 | 88 | 92 |
| 242 | VH5-3 | 1 | 40 | 78 | 81 | 86 | 88 | 92 |
| 243 | VH5-DM | 1 | 41 | 78 | 81 | 86 | 88 | 92 |
| 244 | VH5-DMP | 1 | 41 | 78 | 81 | 86 | 88 | 92 |
| 245 | VH6-1 | 1 | 42 | 77 | 81 | 85 | 88 | 92 |
| 246 | VH6-2 | 1 | 42 | 77 | 81 | 86 | 88 | 92 |
| 247 | VH6-3 | 1 | 42 | 77 | 81 | 86 | 88 | 92 |
| 248 | VH6-DM | 1 | 43 | 77 | 81 | 86 | 88 | 92 |
| 249 | VH6-DMP | 1 | 43 | 77 | 81 | 86 | 88 | 92 |
| 250 | VH7-1 | 8 | 44 | 52 | 81 | 85 | 88 | 92 |
| 251 | VH7-2 | 8 | 44 | 52 | 81 | 86 | 88 | 92 |
| 252 | VH7-3 | 8 | 44 | 52 | 81 | 86 | 88 | 92 |
| 253 | VH7-DM | 8 | 45 | 52 | 81 | 86 | 88 | 92 |
| 254 | VH7-DMP | 8 | 45 | 52 | 81 | 86 | 88 | 92 |
| 255 | VH9-1 | 1 | 46 | 52 | 81 | 85 | 88 | 92 |
| 256 | VH9-2 | 1 | 46 | 52 | 81 | 86 | 88 | 92 |
| 257 | VH9-3 | 1 | 46 | 52 | 81 | 86 | 88 | 92 |
| 258 | VH9-DM | 1 | 47 | 52 | 81 | 86 | 88 | 92 |
| 259 | VH9-DMP | 1 | 47 | 52 | 81 | 86 | 88 | 92 |
| 260 | VH16-1 | 1 | 38 | 52 | 81 | 85 | 88 | 92 |
| 261 | VH16-2 | 1 | 38 | 52 | 81 | 86 | 88 | 92 |
| 262 | VH16-3 | 1 | 38 | 52 | 81 | 86 | 88 | 92 |
| 263 | VH16-DM | 1 | 39 | 52 | 81 | 86 | 88 | 92 |
| 264 | VH16-DMP | 1 | 39 | 52 | 81 | 86 | 88 | 92 |
| 265 | VH27-1 | 8 | 44 | 78 | 81 | 85 | 88 | 92 |
| 266 | VH27-2 | 8 | 44 | 78 | 81 | 86 | 88 | 92 |
| 267 | VH27-3 | 8 | 44 | 78 | 81 | 86 | 88 | 92 |
| 268 | VH27-DM | 8 | 45 | 78 | 81 | 86 | 88 | 92 |
| 269 | VH27-DMP | 8 | 45 | 78 | 81 | 86 | 88 | 92 |
| 270 | VH32-1 | 8 | 12 | 77 | 81 | 85 | 88 | 92 |
| 271 | VH32-2 | 8 | 12 | 77 | 81 | 86 | 88 | 92 |
| 272 | VH32-3 | 8 | 12 | 77 | 81 | 86 | 88 | 92 |
| 273 | VH32-DM | 8 | 13 | 77 | 81 | 86 | 88 | 92 |
| 274 | VH32-DM | 8 | 13 | 77 | 81 | 86 | 88 | 92 |
| 275 | VH35-1 | 1 | 44 | 78 | 81 | 85 | 88 | 92 |
| 276 | VH35-2 | 1 | 44 | 78 | 81 | 86 | 88 | 92 |
| 277 | VH35-3 | 1 | 44 | 78 | 81 | 86 | 88 | 92 |
| 278 | VH35-DM | 1 | 45 | 78 | 81 | 86 | 88 | 92 |
| 279 | VH35-DMP | 1 | 45 | 78 | 81 | 86 | 88 | 92 |
| 280 | VH48 | 8 | 38 | 79 | 81 | 85 | 88 | 92 |
| 281 | VH55 | 1 | 12 | 77 | 81 | 85 | 88 | 92 |
| 282 | VH81 | 1 | 48 | 52 | 81 | 85 | 88 | 92 |
| 283 | C12 | 9 | 12 | 80 | 84 | 85 | 88 | 95 |
| 284 | 1564-VL (N51D) | 1 | 12 | 52 | 81 | 85 | 88 | 92 |
| 285 | 1564-VL (N95aD) | 1 | 12 | 52 | 81 | 85 | 88 | 92 |
| 286 | 1564-VL (N95aH) | 1 | 12 | 52 | 81 | 85 | 88 | 92 |
| 287 | 1564-VL (N95aK) | 1 | 12 | 52 | 81 | 85 | 88 | 92 |
| 288 | 1564-VL (N95aR) | 1 | 12 | 52 | 81 | 85 | 88 | 92 |
| 289 | 1564-VH (N54D) | 1 | 49 | 52 | 81 | 85 | 88 | 92 |
| 290 | 1564-VH (N54Q) | 1 | 13 | 52 | 81 | 85 | 88 | 92 |

TABLE 6

Light chain variable region of the antibody of the present invention

| SEQ ID NO | Light chain (VH) | CDR-L1 | CDR-L2 | CDR-L3 | L-FR1 | L-FR2 | L-FR3 | LFR4 |
|---|---|---|---|---|---|---|---|---|
| 291 | 996-1 | 96 | 114 | 133 | 162 | 165 | 166 | 169 |
| 292 | 996-2 | 96 | 114 | 133 | 162 | 165 | 166 | 170 |
| 293 | 1226-1 | 97 | 115 | 134 | 162 | 165 | 166 | 169 |
| 294 | 1226-2 | 97 | 115 | 134 | 162 | 165 | 166 | 170 |
| 295 | 1564-1 | 98 | 116 | 135 | 162 | 165 | 166 | 169 |
| 296 | 1564-2 | 98 | 116 | 135 | 162 | 165 | 167 | 170 |
| 297 | 1564-3 | 98 | 116 | 135 | 162 | 165 | 166 | 170 |
| 298 | 1564-DM | 98 | 117 | 136 | 162 | 165 | 167 | 170 |
| 299 | 1564-DMP | 98 | 117 | 136 | 162 | 165 | 166 | 170 |
| 300 | 48G5-1 | 99 | 118 | 137 | 162 | 165 | 166 | 169 |
| 301 | 48G5-2 | 99 | 118 | 137 | 162 | 165 | 166 | 170 |
| 302 | 49G11-1 | 100 | 119 | 138 | 162 | 165 | 166 | 169 |
| 303 | 49G11-2 | 100 | 119 | 138 | 162 | 165 | 166 | 170 |
| 304 | 54H4-1 | 101 | 120 | 139 | 162 | 165 | 166 | 169 |
| 305 | 54H4-2 | 101 | 120 | 139 | 162 | 165 | 166 | 170 |
| 306 | 60A11-1 | 102 | 121 | 135 | 162 | 165 | 166 | 169 |
| 307 | 60A11-2 | 102 | 121 | 135 | 162 | 165 | 166 | 170 |
| 308 | 60H6-1 | 103 | 122 | 140 | 162 | 165 | 166 | 169 |
| 309 | 60H6-2 | 103 | 122 | 140 | 162 | 165 | 167 | 170 |
| 310 | 60H6-3 | 103 | 122 | 140 | 162 | 165 | 166 | 170 |
| 311 | A1_OMPSEQ | 104 | 123 | 140 | 163 | 165 | 166 | 169 |
| 312 | A3_OMPSEQ | 105 | 124 | 139 | 162 | 165 | 166 | 169 |
| 313 | A6_OMPSEQ | 104 | 125 | 141 | 162 | 165 | 166 | 169 |
| 314 | A8_OMPSEQ | 103 | 126 | 135 | 162 | 165 | 166 | 169 |
| 315 | A10_OMPSEQ | 106 | 127 | 142 | 162 | 165 | 166 | 169 |
| 316 | A12_OMPSEQ | 107 | 114 | 138 | 162 | 165 | 168 | 169 |
| 317 | B5_OMPSEQ | 99 | 128 | 143 | 164 | 165 | 166 | 169 |
| 318 | B9_OMPSEQ | 108 | 123 | 140 | 162 | 165 | 166 | 169 |
| 319 | B11_OMPSEQ | 99 | 121 | 144 | 162 | 165 | 166 | 169 |
| 320 | C2_OMPSEQ | 109 | 129 | 138 | 162 | 165 | 166 | 169 |
| 321 | C6_OMPSEQ | 110 | 648 | 145 | 162 | 165 | 166 | 169 |
| 322 | C7_OMPSEQ | 111 | 114 | 138 | 162 | 165 | 166 | 169 |
| 323 | C11_OMPSEQ | 99 | 114 | 134 | 162 | 165 | 166 | 169 |
| 324 | D4_OMPSEQ | 110 | 130 | 140 | 162 | 165 | 166 | 169 |
| 325 | E06_OMPSEQ | 111 | 114 | 146 | 162 | 165 | 166 | 171 |
| 326 | E10_OMPSEQ | 102 | 121 | 135 | 162 | 165 | 166 | 169 |
| 327 | E12_OMPSEQ | 110 | 130 | 140 | 162 | 165 | 166 | 169 |
| 328 | F06_OMPSEQ | 99 | 118 | 137 | 162 | 165 | 166 | 169 |
| 329 | F11_OMPSEQ | 112 | 125 | 135 | 162 | 165 | 167 | 169 |
| 330 | F12_OMPSEQ | 103 | 131 | 147 | 162 | 165 | 166 | 169 |
| 331 | G9_OMPSEQ | 113 | 648 | 148 | 162 | 165 | 166 | 169 |
| 332 | C04-1 | 98 | 116 | 149 | 162 | 165 | 166 | 169 |
| 333 | C04-2 | 98 | 116 | 149 | 162 | 165 | 167 | 170 |
| 334 | C04-3 | 98 | 116 | 149 | 162 | 165 | 166 | 170 |
| 335 | C04-DM | 98 | 117 | 150 | 162 | 165 | 167 | 170 |
| 336 | C04-DMP | 98 | 117 | 150 | 162 | 165 | 166 | 170 |
| 337 | F06-1 | 98 | 116 | 151 | 162 | 165 | 166 | 169 |
| 338 | F06-2 | 98 | 116 | 151 | 162 | 165 | 167 | 170 |
| 339 | F06-3 | 98 | 116 | 151 | 162 | 165 | 166 | 170 |
| 340 | F06-DM | 98 | 117 | 152 | 162 | 165 | 167 | 170 |
| 341 | F06-DMP | 98 | 117 | 152 | 162 | 165 | 166 | 170 |
| 342 | B01 | 98 | 116 | 135 | 162 | 165 | 167 | 169 |
| 343 | A07(AR) | 98 | 116 | 135 | 162 | 165 | 167 | 169 |
| 344 | E09 | 98 | 116 | 135 | 162 | 165 | 167 | 169 |
| 345 | D03 | 98 | 116 | 135 | 162 | 165 | 167 | 169 |
| 346 | A02 | 98 | 116 | 153 | 162 | 165 | 167 | 169 |
| 347 | B09 | 98 | 116 | 154 | 162 | 165 | 167 | 169 |
| 348 | B10 | 98 | 116 | 155 | 162 | 165 | 167 | 169 |
| 349 | E06 | 98 | 116 | 156 | 162 | 165 | 167 | 169 |
| 350 | H04 | 98 | 116 | 157 | 162 | 165 | 167 | 169 |
| 351 | A06 | 98 | 116 | 158 | 162 | 165 | 167 | 169 |
| 352 | A07(AM) | 98 | 116 | 159 | 162 | 165 | 167 | 169 |
| 353 | B02 | 98 | 116 | 138 | 162 | 165 | 167 | 169 |
| 354 | VH2-1 | 98 | 116 | 135 | 162 | 165 | 166 | 169 |
| 355 | VH2-2 | 98 | 116 | 135 | 162 | 165 | 167 | 170 |
| 356 | VH2-3 | 98 | 116 | 135 | 162 | 165 | 166 | 170 |
| 357 | VH2-DM | 98 | 117 | 136 | 162 | 165 | 167 | 170 |
| 358 | VH2-DMP | 98 | 117 | 136 | 162 | 165 | 166 | 170 |
| 359 | VH5-1 | 98 | 116 | 135 | 162 | 165 | 166 | 169 |
| 360 | VH5-2 | 98 | 116 | 135 | 162 | 165 | 167 | 170 |
| 361 | VH5-3 | 98 | 116 | 135 | 162 | 165 | 166 | 170 |
| 362 | VH5-DM | 98 | 117 | 136 | 162 | 165 | 167 | 170 |
| 363 | VH5-DMP | 98 | 117 | 136 | 162 | 165 | 166 | 170 |
| 364 | VH6-1 | 98 | 116 | 135 | 162 | 165 | 166 | 169 |

TABLE 6-continued

Light chain variable region of the antibody of the present invention

| SEQ ID NO | Light chain (VH) | CDR-L1 | CDR-L2 | CDR-L3 | L-FR1 | L-FR2 | L-FR3 | LFR4 |
|---|---|---|---|---|---|---|---|---|
| 365 | VH6-2 | 98 | 116 | 135 | 162 | 165 | 167 | 170 |
| 366 | VH6-3 | 98 | 116 | 135 | 162 | 165 | 166 | 170 |
| 367 | VH6-DM | 98 | 117 | 136 | 162 | 165 | 167 | 170 |
| 368 | VH6-DMP | 98 | 117 | 136 | 162 | 165 | 166 | 170 |
| 369 | VH7-1 | 98 | 116 | 135 | 162 | 165 | 166 | 169 |
| 370 | VH7-2 | 98 | 116 | 135 | 162 | 165 | 167 | 170 |
| 371 | VH7-3 | 98 | 116 | 135 | 162 | 165 | 166 | 170 |
| 372 | VH7-DM | 98 | 117 | 136 | 162 | 165 | 167 | 170 |
| 373 | VH7-DMP | 98 | 117 | 136 | 162 | 165 | 166 | 170 |
| 374 | VH9-1 | 98 | 116 | 135 | 162 | 165 | 166 | 169 |
| 375 | VH9-2 | 98 | 116 | 135 | 162 | 165 | 167 | 170 |
| 376 | VH9-3 | 98 | 116 | 135 | 162 | 165 | 166 | 170 |
| 377 | VH9-DM | 98 | 117 | 136 | 162 | 165 | 167 | 170 |
| 378 | VH9-DMP | 98 | 117 | 136 | 162 | 165 | 166 | 170 |
| 379 | VH16-1 | 98 | 116 | 135 | 162 | 165 | 166 | 169 |
| 380 | VH16-2 | 98 | 116 | 135 | 162 | 165 | 167 | 170 |
| 381 | VH16-3 | 98 | 116 | 135 | 162 | 165 | 166 | 170 |
| 382 | VH16-DM | 98 | 117 | 136 | 162 | 165 | 167 | 170 |
| 383 | VH16-DMP | 98 | 117 | 136 | 162 | 165 | 166 | 170 |
| 384 | VH27-1 | 98 | 116 | 135 | 162 | 165 | 166 | 169 |
| 385 | VH27-2 | 98 | 116 | 135 | 162 | 165 | 167 | 170 |
| 386 | VH27-3 | 98 | 116 | 135 | 162 | 165 | 166 | 170 |
| 387 | VH27-DM | 98 | 117 | 136 | 162 | 165 | 167 | 170 |
| 388 | VH27-DMP | 98 | 117 | 136 | 162 | 165 | 166 | 170 |
| 389 | VH32-1 | 98 | 116 | 135 | 162 | 165 | 166 | 169 |
| 390 | VH32-2 | 98 | 116 | 135 | 162 | 165 | 167 | 170 |
| 391 | VH32-3 | 98 | 116 | 135 | 162 | 165 | 166 | 170 |
| 392 | VH32-DM | 98 | 117 | 136 | 162 | 165 | 167 | 170 |
| 393 | VH32-DM | 98 | 117 | 136 | 162 | 165 | 166 | 170 |
| 394 | VH35-1 | 98 | 116 | 135 | 162 | 165 | 166 | 169 |
| 395 | VH35-2 | 98 | 116 | 135 | 162 | 165 | 167 | 170 |
| 396 | VH35-3 | 98 | 116 | 135 | 162 | 165 | 166 | 170 |
| 397 | VH35-DM | 98 | 117 | 136 | 162 | 165 | 167 | 170 |
| 398 | VH35-DMP | 98 | 117 | 136 | 162 | 165 | 166 | 170 |
| 399 | VH48 | 98 | 116 | 135 | 162 | 165 | 166 | 169 |
| 400 | VH55 | 98 | 116 | 135 | 162 | 165 | 166 | 169 |
| 401 | VH81 | 98 | 116 | 135 | 162 | 165 | 166 | 169 |
| 402 | C12 | 98 | 116 | 135 | 162 | 165 | 166 | 169 |
| 403 | 1564-VL (N51D) | 98 | 132 | 135 | 162 | 165 | 167 | 169 |
| 404 | 1564-VL (N95aD) | 98 | 116 | 160 | 162 | 165 | 167 | 169 |
| 405 | 1564-VL (N95aH) | 98 | 116 | 136 | 162 | 165 | 167 | 169 |
| 406 | 1564-VL (N95aK) | 98 | 116 | 161 | 162 | 165 | 167 | 169 |
| 407 | 1564-VL (N95aR) | 98 | 116 | 650 | 162 | 165 | 167 | 169 |
| 408 | 1564-VH (N54D) | 98 | 116 | 135 | 162 | 165 | 166 | 169 |
| 409 | 1564-VH (N54Q) | 98 | 116 | 135 | 162 | 165 | 166 | 169 |

Various heavy and light chain variable regions disclosed herein are set forth in Tables 5 and 6. Each variable region can be bound to the heavy and light chain constant regions to form the respective heavy and light chains of an intact antibody. An example of a combination of a heavy chain variable region and a light chain variable region constituting an anti-IGF1R antibody of the present invention may be a combination of a heavy chain variable region and a light chain variable region of the same clone name as described in Table 5 and Table 6.

In a specific example of the present invention, the anti-IGF1R antibody or its antigen binding fragment comprises at least one selected from the group consisting of:
a heavy chain CDR1 (H-CDR1) comprising an amino acid sequence selected from SEQ ID NOs: 1 to 9,
a heavy chain CDR2 (H-CDR2) comprising an amino acid sequence selected from SEQ ID NOs: 10 to 49,
a heavy chain CDR3 (H-CDR3) comprising an amino acid sequence selected from SEQ ID NOs: 50 to 80;
a light chain CDR1 (L-CDR1) comprising an amino acid sequence selected from SEQ ID NOs: 96 to 113,
a light chain CDR2 (L-CDR2) comprising an amino acid sequence selected from SEQ ID NOs: 114 to 132, and
a light chain CDR3 (L-CDR3) comprising an amino acid sequence selected from SEQ ID NOs: 133 to 161 and 650.

Specifically, the antibody or the antigen binding fragment of the present invention may comprise a heavy chain variable region including a heavy chain CDR1 (H-CDR1) comprising an amino acid sequence selected from SEQ ID NOs: 1 to 9, a heavy chain CDR2 (H-CDR2) comprising an amino acid sequence selected from SEQ ID NOs: 10 to 49, and a heavy chain CDR3 (H-CDR3) comprising an amino acid sequence selected from SEQ ID NOs: 50 to 80, and a light chain variable region including a light chain CDR1 (L-CDR1) comprising an amino acid sequence selected from SEQ ID NOs: 96 to 113, a light chain CDR2 (L-CDR2) comprising an amino acid sequence selected from SEQ ID NOs: 114 to 132, and a light chain CDR3 (L-CDR3) comprising an amino acid sequence selected from SEQ ID NOs: 133 to 161 and 650.

The anti-IGF1R antibody or an antigen binding fragment thereof that specifically recognizes and binds to at least one amino acid selected from the group consisting of Y775, P776, F778, R650, 5791, L798, Glu779, L641, H808, E809, L813, V397, D435, W434, Y460 and C488 in an amino acid sequence of SEQ ID NO: 410. Specifically, an anti-IGF1R antibody or an antigen binding fragment thereof of the present invention can bind to at least one selected from binding site 1 to binding site 3 of a protein including an amino acid sequence of SEQ ID NO: 410. The binding site 1 comprises at least one amino acid selected from the group consisting of Y775, P776, F778, R650, S791, L798 and Glu779, the binding site 2 comprises at least one amino acid selected from the group consisting of L641, H808, E809 and L813, and the binding site 3 comprises at least one amino acid selected from the group consisting of V397, D435, W434, Y460 and C488.

The heavy chain variable region of an antibody or the antigen binding fragment of the present invention can include a heavy chain framework region 1 (H-FR1) located in N-terminus of H-CDR1 comprising an amino acid sequence selected from SEQ ID NOs: 81 to 84,
a heavy chain framework region 2 (H-FR2) located between H-CDR1 and H-CDR2 comprising an amino acid sequence selected from SEQ ID NOs: 85 to 86
a heavy chain framework region 3 (H-FR3) located between H-CDR2 and H-CDR3 comprising an amino acid sequence selected from SEQ ID NOs: 87 to 91, and
a heavy chain framework region 4 (H-FR4) located in C-terminus of H-CDR3 comprising an amino acid sequence selected from SEQ ID NOs: 92 to 95.

The light chain variable region of an antibody or the antigen binding fragment of the present invention can include a light chain framework region 1 (L-FR1) located in N-terminus of L-CDR1 comprising an amino acid sequence selected from SEQ ID NOs: 162 to 164,
a light chain framework region 2 (L-FR2) located between L-CDR1 and L-CDR2 comprising an amino acid sequence of SEQ ID NOs: 165, a light chain framework region 3 (L-FR3) located between L-CDR2 and L-CDR3 comprising an amino acid sequence selected from SEQ ID NOs: 166 to 168, and a light chain framework region 4 (L-FR4) located in C-terminus of L-CDR3 comprising an amino acid sequence selected from SEQ ID NOs: 169 to 171.

Each of the heavy chain variable regions and the light chain variable regions disclosed in Tables 5 and 6 can be used as separate domain antibodies, can be freely combined with each other to form various antibodies, and are linked in a single chain form to obtain single chain antibodies such as scFv.

Herein, "domain antibody" is an immunologically functional immunoglobulin fragment comprising a variable region of heavy chain or a variable region of light chain only. In one embodiment, two or more of VH regions are linked by a covalent bond by a peptide linker, to form a bivalent domain antibody. Two VH regions of this bivalent domain antibody may target the same or different antigens.

Antigen-binding fragments of anti-IGF1R antibodies of the present invention may be one selected from the group consisting of scFv, (scFv)₂, scFv-Fc, Fab, Fab', F(ab')₂, minibody and diabody including antibody fragments comprising one or more complementarity determining regions.

In the antigen-binding fragments, Fab includes a light chain variable region, a heavy chain variable region, a light chain constant region, and a first constant region (CH1) of the heavy chain, and has one antigen binding site. Fab' has a hinge region in the Fab that contains one or more cysteine residues at the C-terminus of the heavy chain CH1 domain. The F(ab')₂ antibody is produced by linking two Fabs with forming disulfide bond between cysteine residues of the Fab' hinge region.

Fv is a minimal antibody fragment having only a heavy chain variable region and a light chain variable region, and includes single-chain variable fragments (scFv) and double-chain variable fragments (Fv). In the double chain Fv, a heavy chain variable region and a light chain variable region may be linked by non-covalent bonds. In the single-chain Fv, the heavy-chain variable region and the light-chain variable region are covalently linked directly or via a peptide linker, or linked directly at the C-terminus to form a scFv dimer-like structure (di-scFv), such as a double-chain Fv. In the present invention, the single-chain Fv is a single polypeptide chain of an antigen-binding region in which heavy and light chain variable regions are directly or linked by a linker, and can be at least one selected from the group consisting of scFv having single chain linked with the heavy chain variable region and the light chain variable region, a form of scFv dimer-like structure (di-scFv), scFv-Fc in which the heavy chain variable region, the light chain variable region and Fc are linked as a single chain form, and the like.

The peptide linker may be as described above, and may be, for example, 1 to 100, such as 2 to 50, or 5 to 25 amino acids length, and the peptide linker can be in a various length within a limit that does not affect the function of the antibody. The kinds of amino acids included in the peptide linker may be composed of one or more amino acids selected from the group consisting of, for example, Gly, Ser and Leu, and specific examples include Gly and Ser residues, or Leu and Ser residues. In a specific example, the peptide linker may be (G4S)n in which n is a repetition number of (G4S) represented by an integer of 1 to 10, such as 2 to 5, especially 3 or 4. An example of the peptide linker may be a peptide consisting of amino acids of SEQ ID NO: 411 or 412.

SEQ ID NO: 411: GGGGSGGGGSGGGGSGGGGS
SEQ ID NO: 412: GGGGSGGGGSGGGGS

The single chain Fv (scFv) can be produced by fusing DNA encoding a peptide linker between DNAs encoding two variable domain polypeptides (VL and VH). The prepared polypeptide can form antigen-binding monomer or multimers (e.g., dimers, trimers or tetramers) depending on the length of the flexible linker between the two variable domains, with folding. By combining polypeptides containing different VLs and VHs, multimeric scFv that bind to different epitopes can be formed.

The antigen-binding fragments can be obtained using proteolytic enzymes (e.g., a restriction digestion of the entire antibody with papain to obtain Fab, and digestion with pepsin to obtain F(ab')₂ fragment), or using genetic recombination technology.

The single-chain antibodies disclosed herein include, but are not limited to, scFvs comprising domain combinations of heavy and light chain variable regions, or combinations of light and heavy chain variable domains comprising CDRs.

In addition, the anti-IGF1R antibody and antigen-binding fragment thereof may include a heavy chain comprising the heavy chain variable region and a light chain comprising the light chain variable region. Specifically, the heavy chain variable region and the light chain variable region may be bound to the heavy chain constant region and the light chain constant region, and the heavy chain and light chain sequences may also be combined to form an intact antibody structure.

The constant region sequences that can be combined with the variable regions of the present invention are provided as an example, and can be appropriately selected from the heavy and light chain constant regions of immunoglobulins (e.g., human immunoglobulins). For example, the heavy chain constant region may be an IgG1 heavy chain constant region, an IgG3 heavy chain constant region, or an IgG4 heavy chain constant region, and the light chain constant region may be a kappa constant region or a lambda light chain constant region, but is not limited thereto.

As an example, the variable region of the present invention may be bound to a constant region to form heavy chain and light chain sequences described below. Table 7 shows examples of the combination of the heavy and light chains. In addition, the exemplary complete antibodies are listed in Table 16. The constant region may be appropriately selected from the heavy chain constant region and the light chain constant region of an immunoglobulin (e.g., human immunoglobulin).

TABLE 7

Exemplary antibodies

| | HC Sequence ID | LC Sequence ID |
|---|---|---|
| 1564 IgG | 413 | 420 |
| 1226 IgG | 414 | 421 |
| 996 IgG | 415 | 422 |
| 48G5 IgG | 416 | 423 |
| 54H4 IgG | 417 | 424 |
| 60H6 IgG | 418 | 425 |
| B11 IgG | 419 | 426 |
| 1564 scFv | | 427 |
| 1226 scFv | | 428 |
| 996 scFv | | 429 |
| 48G5 scFv | | 430 |
| 54H4 scFv | | 431 |
| 60H6 scFv | | 432 |
| B11 scFv | | 433 |

Antibodies described in the present invention also include bispecific antibodies and bifunctional antibodies comprising one or more CDRs or one or more variable regions as described above. The bispecific or bifunctional antibodies are artificial hybrid antibodies that recognize two different targets with or without interrelationships. Bispecific antibodies can be prepared using a variety of methods, such as fusion of hybridomas or ligation of Fab' fragments.

Herein, a "multi-specific antigen-binding protein" or "multi-specific antibody" is targeting two or more antigens or epitopes. Herein, a "bispecific" or "dual-specific" antigen-binding protein or antibody is a hybrid antigen-binding protein or a hybrid antibody having two (2) different antigen-binding sites. This bispecific antibody is one kind of multi-specific antigen-binding protein or multi-specific antibody, and it can be produced by various known methods, for example, methods such as fusion of hybridoma or linking of Fab' fragment.

The multi-specific antibody, for example, an anti-IGF1R antibody and an antigen-binding fragment thereof capable of producing a bi-specific antibody, may include both the anti-IGF1R antibody and antigen-binding fragment thereof, for example, an entire antibody. The antigen-binding fragment may be selected from the group consisting of domain antibodies, scFv, (scFv)$_2$, scFv-Fc, Fab, Fab' and F(ab')$_2$.

The antigen-binding fragment of the anti-IGF1R antibody may be linked with or without a linker, such as a peptide linker. In addition, the heavy and light chain portions in the antigen-binding fragment, such as the heavy chain variable region and the light chain variable region in the scFv fragment, can also be linked with or without a peptide linker. The peptide linker may be as described above.

In the bispecific antibody, the anti-IGF1R antibody and antigen-binding fragments thereof may perform a function of delivering a second antibody or antigen-binding fragment targeting different antigens or epitopes that are bound to it, through the blood brain barrier to brain. The second antibody may be an antibody that exerts efficacy in brain, but is not particularly limited.

The anti-IGF1R antibody or antigen-binding fragment thereof of the present invention may share a specific region or sequence with a different second antibody. For example, the anti-IGF1R antibody may share the constant region or the Fc region of the antibody or antigen-binding fragment of the second antibody.

In addition, the structure of the bispecific antibody in the present invention includes a bivalent form of bispecific antibody, in which an scFv of an anti-IFG1R antibody is linked to each Fc of two heavy chains of a complete immunoglobulin, for example at the ends of the heavy chain directly or via a linker, and a monovalent form of bispecific antibody, in which an scFv of an anti-IGF1R antibody is linked to only one end of the two heavy chains of a complete immunoglobulin directly or via a linker, but a monovalent double antibody is preferred.

Specifically, in one embodiment of the present invention, there is a case in which the monovalent form clone has an improved half-life over the bivalent form clone, and the structure of the monovalent form clone is form that domain antibody (scFv) against IGF1R is bound to only an end of one heavy chain in the intact immunoglobulin via a linker. Specifically, the antibody is a heterodimer applied by Knob-In-Hole method that includes two different heavy chains of the intact immunoglobulin in which one heavy chain has domain antibody (scFv) against IGF1R bound to C-terminus thereof, and the other heavy chain has not any at the C-terminus thereof.

In the bispecific antibody, the second antibody that binds to an anti-IGF1R antibody or antigen-binding fragment thereof may be a human antibody, a humanized antibody, a chimeric antibody, or an isolated antibody specifically binding to IGF1R. The second antibody includes, but is not limited to, complete antibodies, bispecific antibodies, minibodies, domain antibodies, antibody mimetics (or synthetic antibodies), antibody fusions (or antibody conjugates), and fragments thereof.

Hereinafter, the present invention relates to an anti-syn antibody and an antigen-binding fragment thereof.

The alpha-synuclein which can be recognized by the antibody provided herein, can be selected from the mammal alpha-synucleins of human alpha-synuclein, monkey alpha-synuclein (e.g. Rhesus alpha-synuclein), mouse alpha-synuclein, rat alpha-synuclein, and the like. For example, the human alpha-synuclein can be alpha-synuclein (NCBI ID: NP_000336), but is not limited thereto. Unless otherwise stated herein, the alpha-synuclein may refer to human alpha-synuclein, and the antibodies or antigen-binding fragments provided herein have a specific binding property to not only human alpha-synuclein, but also monkey (e.g., Rhesus) alpha-synuclein, rat alpha-synuclein, and/or mouse alpha-synuclein.

The antibody or antigen binding fragment thereof can bind to the C-terminal region of alpha-synuclein, specifically C-terminal region including the peptide comprised of at least 11 or 12 consecutive amino acids including 110 to 120 residues or 111 to 122 residues in SEQ ID NO: 559 of human alpha-synuclein. It has been confirmed that the antibody or antigen binding fragment of the present invention can recognize the antigen recognition region and bind to the alpha-synuclein aggregate with a high binding affinity.

Herein, "affinity" or "affinity degree" is the strength of interaction between an antibody or its antigen-binding fragment and an antigen, and can be determined by properties of the antigen such as size, shape and/or charge of antigen, and CDR sequences and/or physiochemical properties (hydrophilic/hydrophobic properties, electrostatic property and etc.) of the antibody or antigen-binding fragment. Methods for determining affinity are known in the art, and generally indicated as dissociation constant ($K_D$), but not limited thereto.

Herein, "specifically binding to alpha-synuclein or alpha-synuclein aggregate" means that the binding affinity to alpha-synuclein protein or alpha-synuclein aggregate is relatively high compared to other antigens, and for example, may be the dissociate constant ($K_D$) of $0.1 \times 10^{-10}$ M to $2 \times 10^{-10}$ M, or $0.05 \times 10^{-10}$ M to $0.3 \times 10^{-9}$ M to alpha-synuclein aggregates, specifically amyloid fibrils, protofibrils and oligomers, particularly amyloid fibrils, as measured by Octet analysis or SPR analysis, but not limited thereto.

The humanized alpha-synuclein antibodies including light chain and heavy chain according to an embodiment of the present invention, for example, Hu11F11 (ver.1), Hu11F11 (ver.2), and Hu11F11 ABL2-4, exhibit a high activity to promote phagocytic uptake compared to the chimeric alpha-synuclein antibodies. Compared to the chimeric alpha-synuclein antibody, Hu11F11 (ver.1), Hu11F11 (ver.2), Hu11F11 (ver.3), Hu11F11 (ver.4), and ABL2-4 shows high activity of inhibiting the binding of fibril to nerve cell membrane compared to the chimeric alpha-synuclein antibody. Hu11F11 (ver.2), Hu11F11 (ver.4) and ABL2-4 have high activity of inhibiting the propagation of alpha-synuclein secreted from the cells overexpressing alpha-synuclein to other nerve cells compared to the chimeric alpha-synuclein antibody, and show the binding affinity to the alpha-synuclein aggregate, for example, which has a similar or superior activity to the chimeric alpha-synuclein antibody in a cell-based assay.

The alpha-synuclein antibody according to the present invention can inhibit the function of alpha-synuclein aggregates secreted out of nerve cells in the nervous system of a subject to transfer to other normal cells in an extracellular space and to infect the nerve cells (inhibit cell-to-cell transmission of aggregates), and have an ability of promoting the phagocytic action of microglia to alpha-synuclein aggregates in the extracellular space. The alpha-synuclein aggregates propagate from one cell to other cells like prions, and the alpha-synuclein, especially alpha-synuclein aggregates, spread throughout the brain, resulting in synucleinopathies in normal cells. Therefore, alpha-synuclein aggregates are toxic to brain neurons and are well known to cause brain neuron death (neurodegeneration) and neuro-inflammation. Accordingly, as alpha-synuclein aggregates spread to various parts of the brain, the brain cell death and the neuro-inflammation reactions increase and result in occurrence of brain cell death and the resulting behavioral and cognitive impairments which are found with the progression of synucleinopathies such as Parkinson's disease.

Accordingly, the alpha-synuclein antibody of the present invention can prevent the spreading phenomenon of alpha-synuclein aggregates to various regions of the brain by inhibiting the transmission of the alpha-synuclein or alpha-synuclein aggregate between the nerve cells, and reduce the level of the alpha-synuclein aggregates which is an important cause of synucleinopathies by reducing or eliminating the alpha-synuclein aggregates themselves in the extracellular region of the nerve cells of the subject nervous system with the promotion of microglia phagocytosis, resulting in reduction of brain nerve cell death and neuro-inflammatory reaction and further being expected to improve, alleviate or prevent the symptoms and the progress of synucleinopathies such as Parkinson's disease.

In addition, the alpha-synuclein antibody according to the present invention has excellent activities of performing both of two functions of (i) inhibition of the transmission of the alpha-synuclein or alpha-synuclein aggregate between the nerve cells (see the result of cell-based assay disclosed herein), and (ii) reduction of alpha-synuclein aggregates level in the brain nervous system through the promoted phagocytosis of microglial cells. In particular, since the alpha-synuclein antibodies which have been currently in clinical trials or published in the scientific paper have one of the two activities (i) and (ii), it suggests that the alpha-synuclein antibody of the present invention has an advantage in superior prevention or treatment of synucleinopathies to known alpha-synuclein antibodies. Therefore, the alpha-synuclein antibody according to the present invention has more excellent efficacies of reduction and elimination of alpha-synuclein aggregates and inhibition of the action of alpha-synuclein aggregates as etiology, and thus is more effective for synucleinopathies or a symptomatic disease related thereto (e.g., cognitive impairment disorder).

The antibodies or antigen-binding fragments according to the present invention having a high affinity for alpha-synuclein aggregates can reduce the formation of alpha-synuclein aggregates, thereby lowering the concentration of aggregates in the brain. In addition, the antibody or antigen-binding fragment according to the present invention with a high affinity for alpha-synuclein aggregates can reduce the formation of alpha-synuclein aggregates outside the central nervous system and finally, change the equilibrium state between the alpha-synuclein forms bounded by BBB, thereby bringing the effect of lowering the concentration of alpha-synuclein aggregates inside the central nervous system.

This has a great advantage in clinical practice, because the efficacy can be sufficiently obtained even by administering in a more convenient route, for example subcutaneous injection, but not limited thereto. In addition, the antibody or antigen-binding fragment according to the present application can inhibit formation of aggregates by removing monomers, or eliminate both monomers and aggregates, but not limited to this theory.

The antibodies or antigen-binding fragments thereof of the present invention that specifically bind to alpha-synuclein proteins or alpha-synuclein aggregates may not be a naturally-occurring product (it can be a non-naturally occurring product, for example, by chemical synthesis or recombinant method). Recombination techniques are well known in the art.

Herein, "antibody" means a complete immunoglobulin in any isotype, or an antigen-binding fragment which can compete with a complete antibody for binding to a target antigen. For example, it includes chimeric, humanized, complete human or dual-specific antibodies, or their antigen-binding fragments. The antibody is one kind of antigen binding protein by itself. Generally, the complete antibody comprises at least 2 full-length heavy chains and 2 full-length light chains, but in some cases, the antibody may comprise only heavy chains.

The antibody or its antigen-binding fragment may be derived from only one source or be a chimeric antibody. The chimeric antibody comprises a part derived from two kinds of different antibodies, and is described in more detail below. The antibody or its antigen-binding fragment can be produced by hybridoma, recombinant DNA technique, or enzymatic or chemical cutting of an intact antibody. Unless otherwise stated herein, the term of antibody includes antibodies comprising 2 full-length heavy chains and 2 full-length light chains, and their derivatives, variants, fragments, and mutants, and the examples thereof are as described below.

In one embodiment, the antibody includes a monoclonal antibody, bispecific antibody, minibody, domain antibody, antibody mimetic (or synthetic antibody), chimeric antibody, humanized antibody, human antibody, antibody fusion (or antibody conjugate), and fragments thereof, and various types of antibodies disclosed herein without limited thereto. In one embodiment, the fragments of the antibodies disclosed herein can be Fab fragments, Fab' fragments, F(ab')$_2$ fragments, Fv fragments, single-chain fragments (scFv), diabody or a single chain antibody molecule of a single chain prepared by linking a heavy chain variable region and a light chain variable region through a spacer.

Herein, "light chain" includes a full-length light chain and its fragments having a variable region sequence to sufficiently provide binding specificity to an antigen or epitope. The full-length light chain comprises a variable region domain VL and a constant region domain CL. The variable region domain of light chain is present in an N terminus of a light chain polypeptide. The kinds of light chain include kappa and lambda chains.

Herein, "heavy chain" includes a full-length heavy chain and its fragments having a variable region sequence to sufficiently provide binding specificity to an antigen or epitope. The full-length heavy chain comprises a variable region domain VH and three (3) constant region domains of CH1, CH2 and CH3. The VH domain is present in N-terminus of a heavy chain polypeptide and the CH domain is present in a carboxy-terminus, and CH3 is positioned closest to C-terminus. The heavy chain includes IgG (including IgG1, IgG2a, IgG2b, IgG3 and IgG4 subtypes), IgA (including IgA1 and IgA2 subtypes), and isotypes of IgM and IgE.

Herein, "antigen-binding fragments" mean a part of an antibody having specific binding affinity to an antigen, or a polypeptide including the part. For example, the antigen-binding fragment may be a part of antibody including an amino acid residue that confers specificity and/or affinity for the antigen to the antibody by interacting with an antigen (e.g., an epitope), or a polypeptide including the part. This antigen-binding fragment typically comprises one or more "complementary determining regions" (CDRs), and further one or more "framework regions" (FRs). CDRs are amino acid sequences that contribute to the specificity and affinity of antibody for binding to antigen, and the framework regions are the amino acid sequences contributing to the maintenance of an appropriate conformation of these CDRs and promote the binding between the antigen-binding region and an antigen.

As used herein, "antigen-binding fragment" of a chain (heavy chain or light chain) of an antibody or immunoglobulin includes a part of an antibody which lacks some amino acids compared to a full-length chain, but can specifically bind to an antigen. This fragment can be considered as having biological activity, in an aspect that it can specifically bind to a target antigen, or can compete with other antibodies or an antigen-binding fragment to bind a specific epitope. In one aspect, this fragment comprises at least one CDR present in a full-length light chain or heavy chain, and in some embodiments, it comprises a single chain of heavy chain and/or light chain, or its part. This biologically-active fragment may be produced by a recombinant DNA technique or may be produced, for example, by cutting an intact antibody enzymatically or chemically. An immunologically-functional immunoglobulin fragment includes Fab, Fab', F(ab')$_2$, Fv, domain antibody and single chain antibody (e.g., scFv, scFv-Fc etc.) but not limited thereto, and may be derived from any mammal including human, mouse, rat, camelid or rabbit, but not limited thereto. The functional part of the antibody such as one or more CDRs described herein may be linked with a secondary protein or small molecular compound by a covalent bond, and be used as a target therapeutic agent to a specific target.

Herein, a "Fab fragment" consists of one light chain and one heavy chain comprising a variable region and CH1 only. The heavy chain of a Fab molecule cannot form a disulfide bond with other heavy chains.

Herein, an "Fc region" comprises two heavy chain fragments comprising CH2 and CH3 domains of an antibody. These 2 heavy chain fragments are combined with each other by two or more disulfide bonds and hydrophobic interaction of CH3 domain.

Herein, a "Fab' fragment" comprises additionally a region between CH1 and CH2 domains of a heavy chain, in addition to Fab fragment, and can be formed by the disulfide bond between two heavy chains of two Fab' fragments.

Herein, a "F(ab')$_2$ fragment" comprises two light chains, and two heavy chains comprising a variable region, CH1 and a part of a constant region between CH1 and CH2 domains, as aforementioned, and an interchain disulfide bond is formed between 2 heavy chains. Thus, the F(ab')$_2$ fragment consists of two Fab' fragments, and the two Fab' fragments are combined with each other by the disulfide bond formed between them.

Herein, an "Fv region" is a fragment of an antibody which comprises each variable region of a heavy chain and a light chain, but does not comprise a constant region.

Herein, a "single chain antibody" is a single polypeptide chain of the antigen-binding region formed by connecting heavy chain variable region and light chain variable region via flexible linker. For example, the single chain antibody may be at least one selected from the group consisting of an scFv in which the heavy chain variable region and the light chain variable region are linked in a single chain form, an scFv-Fc in which the heavy chain variable region, a light chain variable region, and Fc are linked in a single chain form, and the like. The single chain antibody may refer to for example, U.S. Pat. No. 5,260,203.

Herein, a "bivalent antigen-binding protein" or "bivalent antibody" comprises two antigen-binding sites. The two antigen-binding sites comprised in this bivalent antibody may have the same antigen specificity or may be a dual-specific antibody binding to different antigens respectively. Herein, a "multi-specific antigen-binding protein" or "multi-specific antibody" is targeting two or more of antigens or epitopes.

Herein, a "bispecific" or "dual-specific" antigen-binding protein or antibody is a hybrid antigen-binding protein or antibody having two different antigen-binding sites. Such a bispecific antibody is a kind of multi-specific antigen binding protein or multi-specific antibody, and can be produced by various known methods such as fusion of hybridomas or fusion of Fab' fragments.

For example, Songsivilai and Lachmann, *Clin. Exp. Immunol.* 1990, 79:315-321; Kostelny et al., *J. Immunol.* 1992, 148:1547-1553 and the like may be referred. The two epitopes being different each other to which two antigen-binding sites of the bispecific antigen-binding protein or antibody bind may be positioned on the same or different target protein. In one embodiment, the antibody of the present invention may be in the form of a bispecific antibody which additionally comprises binding to a delivery carrier for delivering the antibody through the blood brain barrier. One method for delivering drugs through the blood brain barrier includes the use of delivery systems such as receptor-mediated transcytosis such as glucose transporter, amino acid transporter, insulin receptor or transferrin receptor in a cell.

Herein, a "conjugate" means a chimeric molecule of the antibody or its antigen-binding fragment disclosed herein with other molecule, particularly blood brain barrier transports or a therapeutic agent described below. In the conjugate, the antibody or its antigen-binding fragment of the present invention is bound to other molecules by a covalent bond, or physical force such as van der Waals or hydrophobic interaction, capsulation, embedding or the combination method thereof. In the conjugate of one embodiment, the antibody or its antigen-binding fragment of the present invention may be connected by a peptide linker.

The present invention also includes one or more amino acid sequences having substantial sequence identity to one or more amino acid sequences disclosed herein. The substantial sequence identity means that the sequence with the variation maintains the effects disclosed in the present invention. In an embodiment, the sequence has about 90%, 95%, or 99% of sequence identity to the heavy chain variable region disclosed. In an embodiment, the sequence has about 90%, 95%, or 99% of sequence identity to the light chain variable region disclosed. For example, in the case of a variant showing 90%, 95%, or 99% of sequence identity to the sequence of the antibody or antigen-binding fragment disclosed in the present invention, any sequence variation occurs in the framework of the variable region rather than the CDR.

The antibodies or antigen-binding fragments thereof specifically binding to alpha-synuclein or an aggregate thereof according to the present invention include a heavy chain variable region comprising complementarity determining regions of CDRH1, CDRH2 and CDRH3; and a light chain variable region comprising complementarity determining regions of CDRL1, CDRL2, and CDRL3.

In an embodiment, the anti-alpha-synuclein antibody or antigen-binding fragment thereof may include the following CDR sequences:

a heavy chain CDR1 (H-CDR1) selected from the amino acid sequences of SEQ ID NO: 434 and SEQ ID NO: 439, a heavy chain CDR2 (H-CDR2) selected from the amino acid sequences of SEQ ID NOs: 435 to 437 and 649, and SEQ ID NOs: 440 to 441, a heavy chain CDR3 (H-CDR3) selected from the amino acid sequences of SEQ ID NO: 438 and SEQ ID NO: 442, a light chain CDR1 (L-CDR1) selected from the amino acid sequences of SEQ ID NO: 443 and SEQ ID NO: 446, a light chain CDR2 (L-CDR2) selected from the amino acid sequences of SEQ ID NO: 444 and SEQ ID NO: 447, and a light chain CDR3 (L-CDR3) selected from the amino acid sequences of SEQ ID NO: 445 and SEQ ID NO: 448.

The amino acid sequences of the heavy chain CDR1 to CDR3 and the amino acid sequences of the light chain CDR1 to CDR3 are summarized in Tables 8 and 9.

TABLE 8

Amino acid sequences of Heavy chain CDR1 to CDR3

| Clone ID | SEQVH_CDR1 ID NO: | Amino acid sequence | SEQVH_CDR2 ID NO: | Amino acid sequence | SEQVH_CDR3 ID NO: | Amino acid sequence |
|---|---|---|---|---|---|---|
| ch11F11-VH | 434 | GFTFSDFYME | 435 | ASRNKANDYTTEYSASVKG | 438 | DAHGKPFAY |
| Hu11F11-VH1 | 434 | GFTFSDFYME | 436 | AIRNKANDYTTEYAASVKG | 438 | DAHGKPFAY |
| Hu11F11-VH2 | 434 | GFTFSDFYME | 436 | AIRNKANDYTTEYAASVKG | 438 | DAHGKPFAY |
| Hu11F11-VH3 | 434 | GFTFSDFYME | 649 | AIRNKANDYTTEYADSVKG | 438 | DAHGKPFAY |
| Hu11F11-VH4 | 434 | GFTFSDFYME | 649 | AIRNKANDYTTEYADSVKG | 438 | DAHGKPFAY |
| Hu11F11-VHv3 | 434 | GFTFSDFYME | 437 | ATRNKANDYTTEYSASVKG | 438 | DAHGKPFAY |
| Hu11F11-VHv1mu1 newmu | 434 | GFTFSDFYME | 437 | ATRNKANDYTTEYSASVKG | 438 | DAHGKPFAY |
| Hu11F11-VHv3 newmu | 434 | GFTFSDFYME | 437 | ATRNKANDYTTEYSASVKG | 438 | DAHGKPFAY |
| Hu11F11-VH-v1 | 434 | GFTFSDFYME | 435 | ASRNKANDYTTEYSASVKG | 438 | DAHGKPFAY |
| Hu11F11-VH-v2 | 434 | GFTFSDFYME | 435 | ASRNKANDYTTEYSASVKG | 438 | DAHGKPFAY |
| Hu11F11-VH-v3 | 434 | GFTFSDFYME | 435 | ASRNKANDYTTEYSASVKG | 438 | DAHGKPFAY |
| Hu11F11-VH-v4 | 434 | GFTFSDFYME | 435 | ASRNKANDYTTEYSASVKG | 438 | DAHGKPFAY |
| ch3A9-VH | 439 | GFTFSSYAMS | 440 | TISNGGGYTYYPDSVKG | 442 | HITTVRPTKYFDY |
| Hu3A9-VH1 | 439 | GFTFSSYAMS | 440 | TISNGGGYTYYPDSVKG | 442 | HITTVRPTKYFDY |
| Hu3A9-VH2 | 439 | GFTFSSYAMS | 441 | TISNGGGYTYYADSVKG | 442 | HITTVRPTKYFDY |
| Hu3A9-VH3 | 439 | GFTFSSYAMS | 440 | TISNGGGYTYYPDSVKG | 442 | HITTVRPTKYFDY |
| Hu3A9-VH4 | 439 | GFTFSSYAMS | 441 | TISNGGGYTYYADSVKG | 442 | HITTVRPTKYFDY |

TABLE 8-continued

Amino acid sequences of Heavy chain CDR1 to CDR3

| Clone ID | SEQ ID NO: | VH_CDR1 Amino acid sequence | SEQ ID NO: | VH_CDR2 Amino acid sequence | SEQ ID NO: | VH_CDR3 Amino acid sequence |
|---|---|---|---|---|---|---|
| Hu3A9-VH-v1 | 439 | GFTFSSYAMS | 440 | TISNGGGYTYYPDSVKG | 442 | HITTVRPTKYFDY |
| Hu3A9-VH-v2 | 439 | GFTFSSYAMS | 440 | TISNGGGYTYYPDSVKG | 442 | HITTVRPTKYFDY |

TABLE 9

Amino acid sequences of Light chain CDR1 to CDR3

| Clone ID | SEQ ID NO | VL_CDR1 Amino acid sequence | SEQ ID NO | VL_CDR1 Amino acid sequence | SEQ ID NO | VL_CDR1 Amino acid sequence |
|---|---|---|---|---|---|---|
| ch11F11-VL | 443 | KSSQSLLYSSNQKNYLA | 444 | WASTRES | 445 | QQYYSYPWT |
| Hu11F11-VL1 | 443 | KSSQSLLYSSNQKNYLA | 444 | WASTRES | 445 | QQYYSYPWT |
| Hu11F11-VL2 | 443 | KSSQSLLYSSNQKNYLA | 444 | WASTRES | 445 | QQYYSYPWT |
| Hu11F11-VL3 | 443 | KSSQSLLYSSNQKNYLA | 444 | WASTRES | 445 | QQYYSYPWT |
| Hu11F11-VL4 | 443 | KSSQSLLYSSNQKNYLA | 444 | WASTRES | 445 | QQYYSYPWT |
| Hu11F11-VL5 | 443 | KSSQSLLYSSNQKNYLA | 444 | WASTRES | 445 | QQYYSYPWT |
| Hu11F11-VLv3 4c | 443 | KSSQSLLYSSNQKNYLA | 444 | WASTRES | 445 | QQYYSYPWT |
| ch3A9-VL | 446 | KASQNVGTTVA | 447 | SASNRYT | 448 | QQYSNYPLT |
| Hu3A9-VL1 | 446 | KASQNVGTTVA | 447 | SASNRYT | 448 | QQYSNYPLT |
| Hu3A9-VL2 | 446 | KASQNVGTTVA | 447 | SASNRYT | 448 | QQYSNYPLT |
| Hu3A9-VL3 | 446 | KASQNVGTTVA | 447 | SASNRYT | 448 | QQYSNYPLT |
| Hu3A9-VL4 | 446 | KASQNVGTTVA | 447 | SASNRYT | 448 | QQYSNYPLT |
| Hu3A9-VL-v1 | 446 | KASQNVGTTVA | 447 | SASNRYT | 448 | QQYSNYPLT |
| Hu3A9-VL-v2 | 446 | KASQNVGTTVA | 447 | SASNRYT | 448 | QQYSNYPLT |
| Hu3A9-VL-v2 | 446 | KASQNVGTTVA | 447 | SASNRYT | 448 | QQYSNYPLT |

In an embodiment, the anti-alpha-synuclein antibody or antigen-binding fragment thereof can include a heavy chain variable region including a heavy chain CDR1 (H-CDR1) comprising an amino acid sequence of SEQ ID NO: 434, heavy chain CDR2 (H-CDR2) comprising an amino acid sequence selected from the amino acid sequences of SEQ ID NOs: 435 to 437 and 649, and a heavy chain CDR3 (H-CDR3) comprising an amino acid sequence of SEQ ID NO: 438; and a heavy chain variable region including a light chain CDR1 (L-CDR1) comprising an amino acid sequence of SEQ ID NO: 443, a light chain CDR2 (L-CDR2) comprising an amino acid sequence of SEQ ID NO: 444 and a light chain CDR3 (L-CDR3) comprising an amino acid sequence of SEQ ID NO: 445.

Additionally, in an embodiment, the anti-alpha-synuclein antibody or antigen-binding fragment thereof can include a heavy chain variable region including a heavy chain CDR1 (H-CDR1) comprising an amino acid sequence of SEQ ID NO: 439, heavy chain CDR2 (H-CDR2) comprising an amino acid sequence selected from the amino acid sequences of SEQ ID NOs: 440 to 441, and a heavy chain CDR3 (H-CDR3) comprising an amino acid sequence of SEQ ID NO: 442; and a heavy chain variable region including a light chain CDR1 (L-CDR1) comprising an amino acid sequence of SEQ ID NO: 446, a light chain CDR2 (L-CDR2) comprising an amino acid sequence of SEQ ID NO: 447, and a light chain CDR3 (L-CDR3) comprising an amino acid sequence of SEQ ID NO: 448.

In another embodiment, the anti-alpha-synuclein antibody or antigen-binding fragment thereof can include
- a heavy chain framework (H-FR1) located at N-terminus of H-CDR1 comprising a polypeptide fragment including an amino acid sequence selected from SEQ ID NOs: 449 to 450 and SEQ ID NOs: 468 to 473,
- a heavy chain framework (H-FR2) located between H-CDR1 and H-CDR2 comprising a polypeptide fragment including an amino acid sequence selected from SEQ ID NOs: 451 to 452 and SEQ ID NOs: 474 to 477,
- a heavy chain framework (H-FR3) located between H-CDR2 and H-CDR3 comprising a polypeptide fragment including an amino acid sequence selected from SEQ ID NOs: 453 to 464 and SEQ ID NOs: 478 to 483,
- a heavy chain framework (H-FR4) being located at C-terminus of H-CDR3 comprising a polypeptide fragment including an amino acid sequence selected from SEQ ID NOs: 465 to 467 and SEQ ID NOs: 484 to 485,
- a light chain framework (L-FR1) located at N-terminus of L-CDR1 comprising a polypeptide fragment including an amino acid sequence selected from SEQ ID NOs: 486 to 491 and SEQ ID NOs: 504 to 510,
- a light chain framework (L-FR2) located between L-CDR1 and L-CDR2 comprising a polypeptide fragment including an amino acid sequence selected from SEQ ID NOs: 492 to 494 and SEQ ID NOs: 511 to 514,
- a light chain framework (L-FR3) located between L-CDR2 and L-CDR3 comprising a polypeptide fragment including an amino acid sequence selected from SEQ ID NOs: 495 to 500 and SEQ ID NOs: 515 to 521, and/or
- a light chain framework (L-FR4) located at C-terminus of L-CDR3 comprising a polypeptide fragment including an amino acid sequence selected from SEQ ID NOs: 501 to 503 and SEQ ID NO: 522.

As the amino acid sequences being useful as frameworks herein, the heavy chain framework region sequences and light chain framework region sequences are exemplified in Tables 10 to 13.

TABLE 10

Amino acid sequences of heavy chain frameworks 1 to 2

| Clone | SEQ ID NO: | VH-FR1-Sequence | SEQ ID NO: | VH-FR2 Sequence |
|---|---|---|---|---|
| ch11F11-VH | 449 | EVQLQESGGGLVQPGGSLRLSCATS | 451 | WVRQPPGKRLEWIA |
| Hu11F11-VH1 | 471 | EVOLVESGGGLVQPGGSLRLSCAAS | 452 | WVRQAPGKGLEWIA |
| Hu11F11-VH2 | 471 | EVOLVESGGGLVQPGGSLRLSCAAS | 452 | WVRQAPGKGLEWIA |
| Hu11F11-VH3 | 471 | EVOLVESGGGLVQPGGSLRLSCAAS | 452 | WVRQAPGKGLEWIA |
| Hu11F11-VH4 | 471 | EVOLVESGGGLVQPGGSLRLSCAAS | 475 | WVRQAPGKGLEWVA |
| Hu11F11-VHv3 | 450 | EVQLVESGGGLVQPGGSLRLSCATS | 451 | WVRQPPGKRLEWIA |
| Hu11F11-VHv1mu1 newmu | 450 | EVOLVESGGGLVQPGGSLRLSCATS | 451 | WVRQPPGKRLEWIA |
| Hu11F11-VHv3 newmu | 450 | EVOLVESGGGLVQPGGSLRLSCATS | 451 | WVRQPPGKRLEWIA |
| Hu11F11-VH-v1 | 450 | EVOLVESGGGLVQPGGSLRLSCATS | 451 | WVRQPPGKRLEWIA |
| Hu11F11-VH-v2 | 450 | EVOLVESGGGLVQPGGSLRLSCATS | 451 | WVRQPPGKRLEWIA |
| Hu11F11-VH-v3 | 450 | EVOLVESGGGLVQPGGSLRLSCATS | 451 | WVRQPPGKRLEWIA |
| Hu11F11-VH-v4 | 450 | EVOLVESGGGLVQPGGSLRLSCATS | 451 | WVRQPPGKRLEWIA |
| ch3A9-VH | 468 | EVQLQESGGGLVKPGGSLKLSCAAS | 474 | WVRQTPEKRLEWVA |
| Hu3A9-VH1 | 469 | QVQLLESGGGLVQPGGSLRLSCAAS | 475 | WVRQAPGKGLEWVA |
| Hu3A9-VH2 | 470 | EVQLVQSGGGLVQPGGSLRLSCAAS | 476 | WVRQAPDKGLEWVA |
| Hu3A9-VH3 | 471 | EVOLVESGGGLVQPGGSLRLSCAAS | 475 | WVRQAPGKGLEWVA |
| Hu3A9-VH4 | 471 | EVQLVESGGGLVQPGGSLRLSCAAS | 475 | WVRQAPGKGLEWVA |
| Hu3A9-VH-v1 | 472 | EVQLLESGGGLVQPGGSLRLSCAAS | 477 | WVRQTPEKGLEWVA |
| Hu3A9-VH-v2 | 473 | EVQLLESGGGLVQPGGSLKLSCAAS | 477 | WVRQTPEKGLEWVA |

TABLE 11

Amino acid sequences of heavy chain frameworks 3 to 4

| Clone | SEQ ID NO: | VH-FR3-Sequence | SEQ ID NO: | VH-FR4 Sequence |
|---|---|---|---|---|
| ch11F11-VH | 453 | RFIVSRDTSQSILYLQMNALRAEDTAIYYCAR | 465 | WGQGTLVTVSA |
| Hu11F11-VH1 | 454 | RFTVSRDTSKNSLYLQMNSLKTEDTAVYYCAR | 466 | WGQGTLVTVSS |
| Hu11F11-VH2 | 455 | RFTISRDTSKNSLYLQMNSLKTEDTAVYYCAR | 466 | WGQGTLVTVSS |
| Hu11F11-VH3 | 456 | RFTVSRDTSQNTLYLQMNSLRAEDTAVYYCAR | 466 | WGQGTLVTVSS |
| Hu11F11-VH4 | 457 | RFTISADTSKNTAYLQMNSLRAEDTAVYYCSR | 466 | WGQGTLVTVSS |
| Hu11F11-VHv3 | 458 | RFTISRDDSKSSLYLQMNSLRAEDTAIYYCAR | 467 | WGQGTTVTVSS |
| Hu11F11-VHv1mu1 newmu | 459 | RFTISRDTSQSSLYLQMNSLKTEDTAVYYCAR | 467 | WGQGTTVTVSS |
| Hu11F11-VHv3 newmu | 460 | RFTISRDTSQSSLYLQMNSLRAEDTAIYYCAR | 467 | WGQGTTVTVSS |
| Hu11F11-VH-v1 | 461 | RFTISRDDSKSSLYLQMNSLRAEDTAIYYCAR | 467 | WGQGTTVTVSS |
| Hu11F11-VH-v2 | 462 | RFTVSRDDSKSSLYLQMNSLRAEDTAIYYCAR | 467 | WGQGTTVTVSS |
| Hu11F11-VH-v3 | 463 | RFTISRDTSKSSLYLQMNSLRAEDTAIYYCAR | 467 | WGQGTTVTVSS |
| Hu11F11-VH-v4 | 464 | RFTVSRDTSKSSLYLQMNSLRAEDTAIYYCAR | 467 | WGQGTTVTVSS |
| ch3A9-VH | 478 | RFTISRDNAKNTLYLQMSSLRSEDTAMYYCAR | 484 | WGQGTTLTVSS |
| Hu3A9-VH1 | 479 | RFTISRDNAKNTLYLQMNSLRSEDSAMYYCAR | 485 | WGQGTLVTVSS |
| Hu3A9-VH2 | 480 | RFTISRDNAKNTLYLQMSSLKAEDSAVYYCAR | 485 | WGQGTLVTVSS |
| Hu3A9-VH3 | 481 | RFTISRDNSKNTLYLQMNSLRAEDTAVYYCAR | 485 | WGQGTLVTVSS |
| Hu3A9-VH4 | 482 | RFTISADTSKNTAYLQMNSLRAEDTAVYYCAR | 485 | WGQGTLVTVSS |
| Hu3A9-VH-v1 | 483 | RFTISRDNSKNTLYLQMSSLRAEDTAMYYCAR | 484 | WGQGTTLTVSS |
| Hu3A9-VH-v2 | 483 | RFTISRDNSKNTLYLQMSSLRAEDTAMYYCAR | 484 | WGQGTTLTVSS |

TABLE 12

Amino acid sequences of light chain frameworks 1 to 2

| Clone | SEQ ID NO: | VL-FR1-Sequence | SEQ ID NO: | VL-FR2 Sequence |
|---|---|---|---|---|
| ch11F11-VL | 486 | DIVMTQSPSSLAVSVGEKVTMSC | 492 | WYQQKPGQSPKLLIY |
| Hu11F11-VL1 | 487 | DIVMTQSPDSLAVSLGERATINC | 493 | WYQQKPGQPPKLLIY |
| Hu11F11-VL2 | 488 | DIVMTQSPSSLAVSLGERVTITC | 493 | WYQQKPGQPPKLLIY |
| Hu11F11-VL3 | 489 | DIVMTQSPSSLAVSLGERATINC | 493 | WYQQKPGQPPKLLIY |
| Hu11F11-VL4 | 490 | DIQMTQSPSSLSASVGDRVTITC | 494 | WYQQKPGKAPKLLIY |
| Hu11F11-VL5 | 486 | DIVMTQSPSSLAVSVGEKVTMSC | 493 | WYQQKPGQPPKLLIY |
| Hu11F11-VLv3 4c | 491 | DIVMTQSPSSLAVSLGERVTMSC | 492 | WYQQKPGQSPKLLIY |
| ch3A9-VL | 504 | DIVMTQSPKFMSTSVGDRVSITC | 511 | WYQQKPGQSPKLLIY |
| Hu3A9-VL1 | 505 | DIQMTQSPSSLSASVGDRVTITC | 512 | WYQQKPGKAPKLLIY |
| Hu3A9-VL2 | 506 | DIVMTQSPSTLSASVGDRVTITC | 513 | AWYQQKPGKAPKLLIY |
| Hu3A9-VL3 | 507 | DIVMTQSPATLSVSLGERATLSC | 514 | WYQQKPGQAPRLLIY |

TABLE 12-continued

Amino acid sequences of light chain frameworks 1 to 2

| Clone | SEQ ID NO: | VL-FR1-Sequence | SEQ ID NO: | VL-FR2 Sequence |
|---|---|---|---|---|
| Hu3A9-VL4 | 508 | DIQMTQSPSSLSASVGDRVTITC | 512 | WYQQKPGKAPKLLIY |
| Hu3A9-VL-v1 | 509 | DIQMTQSPSSLSASVGDRVTITC | 511 | WYQQKPGQSPKLLIY |
| Hu3A9-VL-v2 | 510 | DIVMTQSPSSMSTSVGDRVTITC | 511 | WYQQKPGQSPKLLIY |
| Hu3A9-VL-v2 | 510 | DIVMTQSPSSMSTSVGDRVTITC | 511 | WYQQKPGQSPKLLIY |

TABLE 13

Amino acid sequences of light chain frameworks 3 to 4

| Clone | SEQ ID NO: | VL-FR3-Sequence | SEQ ID NO: | VL-FR4 Sequence |
|---|---|---|---|---|
| ch11F11-VL | 495 | GVPDRFTGSGSGTDFTLTISSVKAEDLAVYYC | 501 | FGGGTKLEIK |
| Hu11F11-VL1 | 496 | GVPDRFSGSGSGTDFTLTISSLQAEDVAVYYC | 502 | FGGGTKVEIK |
| Hu11F11-VL2 | 497 | GVPDRFSGSGSGTDFTLTISSVQAEDVAVYYC | 501 | FGGGTKLEIK |
| Hu11F11-VL3 | 496 | GVPDRFSGSGSGTDFTLTISSLQAEDVAVYYC | 501 | FGGGTKLEIK |
| Hu11F11-VL4 | 498 | GVPSRFSGSGSGTDFTLTISSLQPEDFATYYC | 503 | FGQGTKVEIK |
| Hu11F11-VL5 | 499 | GVPDRFSGSGSGTDFTLTISSVQAEDLAVYYC | 501 | FGGGTKLEIK |
| Hu11F11-VLv3 4c | 500 | GVPDRFTGSGSGTDFTLTISSVKAEDVAVYYC | 501 | FGGGTKLEIK |
| ch3A9-VL | 515 | GVPDRFTGSGSGTDFTLTISNMQSEDLADYFC | 522 | FGAGTKLELR |
| Hu3A9-VL1 | 516 | GVPDRFSGSGSGTDFTLTISSLQPEDFATYYC | 522 | FGAGTKLELR |
| Hu3A9-VL2 | 517 | GVPSRFSGSGSGTEFTLTISSLQPDDFASYYC | 522 | FGAGTKLELR |
| Hu3A9-VL3 | 518 | GIPARFSGSGSGTEFTLTISSLQSEDFAVYYC | 522 | FGAGTKLELR |
| Hu3A9-VL4 | 519 | GVPSRFSGSGSGTDFTLTISSLQPEDFATYYC | 522 | FGAGTKLELR |
| Hu3A9-VL-v1 | 520 | GVPDRFSGSGSGTDFTFTISSMQSEDIATYFC | 522 | FGAGTKLELR |
| Hu3A9-VL-v2 | 521 | GVPDRFSGSGSGTDFTLTISSMQSEDLADYYC | 522 | FGAGTKLELR |
| Hu3A9-VL-v2 | 521 | GVPDRFSGSGSGTDFTLTISSMQSEDLADYYC | 522 | FGAGTKLELR |

In another embodiment, the anti-alpha-synuclein antibody or antigen-binding fragment thereof can include a heavy chain variable region comprising a heavy chain CDR1 (H-CDR1) comprising an amino acid selected from SEQ TD NO: 434 and SEQ TD NO: 439, a heavy chain CDR2 (H-CDR2) comprising an amino acid selected from SEQ ID NOs: 435 to 437 and 649, and SEQ TD NOs: 440 to 441, and a heavy chain CDR3 (H-CDR3) comprising an amino acid selected from SEQ ID NO: 438 and SEQ ID NO: 442,
in which the heavy chain variable region further comprises a heavy chain framework region (H-FR1) comprising an amino acid sequence selected from SEQ TD NOs: 449 to 450 and SEQ ID NOs: 468 to 473, a heavy chain framework region (H-FR2) comprising an amino acid sequence selected from SEQ TD NOs: 451 to 452 and SEQ ID NOs: 474 to 477, a heavy chain framework region (H-FR3) comprising an amino acid sequence selected from SEQ ID NOs: 453 to 464 and SEQ ID NOs: 478 to 483, and a heavy chain framework region (H-FR4) comprising an amino acid sequence selected from SEQ ID NOs: 465 to 467 and SEQ ID NOs: 484 to 485. More specifically, the heavy chain variable region comprises a heavy chain framework region (H-FR1) comprising an amino acid sequence of SEQ ID NO: 450, a heavy chain framework region (H-FR2) comprising an amino acid sequence of SEQ ID NO: 451, a heavy chain framework region (H-FR3) comprising an amino acid sequence selected from SEQ ID NOs: 462 to 464, and a heavy chain framework region (H-FR4) comprising an amino acid sequence of SEQ ID NO: 467.

In addition, the anti-alpha-synuclein antibody or antigen-binding fragment thereof can include a light chain variable region comprising a light chain CDR1 (L-CDR1) comprising an amino acid sequence selected from SEQ ID NO: 443 and SEQ ID NO: 446, a light chain CDR2 (L-CDR2) comprising an amino acid sequence selected from SEQ ID NO: 444 and SEQ ID NO: 447, and a light chain CDR3

(L-CDR3) comprising an amino acid sequence selected from SEQ ID NO: 445 and SEQ ID NO: 448, in which the light chain variable region further comprises a light chain framework region (L-FR1) comprising an amino acid sequence selected from SEQ ID NOs: 486 to 491 and SEQ ID NOs:504 to 510, a light chain framework region (L-FR2) comprising an amino acid sequence selected from SEQ ID NOs: 492 to 494 and SEQ ID NOs: 511 to 514, a light chain framework region (L-FR3) comprising an amino acid sequence selected from SEQ ID NOs:495 to 500 and SEQ ID NOs: 515 to 521, and a light chain framework region (L-FR4) comprising an amino acid sequence selected from SEQ ID NOs: 501 to 503 and SEQ ID NO: 522. More specifically, the light chain variable region comprises a light chain framework region (L-FR1) comprising a polypeptide fragment including an amino acid sequence of SEQ ID NO: 491, a light chain framework region (L-FR2) comprising a polypeptide fragment including an amino acid sequence of SEQ ID NO: 492, a light chain framework region (L-FR3) comprising a polypeptide fragment including an amino acid sequence of SEQ ID NO: 500 and a light chain framework region (L-FR4) comprising a polypeptide fragment including an amino acid sequence of SEQ ID NO: 501.

The antibody or antigen binding fragment thereof according to an embodiment of the present invention can comprise a heavy chain variable region comprising a heavy chain CDR1 (H-CDR1) comprising an amino acid sequence of SEQ ID NO: 434, a heavy chain CDR2 (H-CDR2) comprising an amino acid sequence selected from SEQ ID NO: 435 to 437 and 649, and a heavy chain CDR3 (H-CDR3) comprising an amino acid sequence of SEQ ID NO: 438. and a light chain variable region comprising a light chain CDR1 (L-CDR1) comprising an amino acid sequence of SEQ ID NO: 443, light chain CDR2 (L-CDR2) comprising an amino acid sequence of SEQ ID NO: 444, and a light chain CDR3 (L-CDR3) comprising an amino acid sequence of SEQ ID NO: 445, in which the heavy chain variable region comprises a heavy chain framework region (H-FR1) comprising an amino acid sequence selected from SEQ ID NOs: 449, 450, and 471, a heavy chain framework region (H-FR2) comprising an amino acid sequence selected from SEQ ID NOs: 451, 452, and 475, a heavy chain framework region (H-FR3) comprising an amino acid sequence selected from SEQ ID NOs: 453 to 464, and a heavy chain framework region (H-FR4) comprising an amino acid sequence selected from SEQ ID NOs: 465 to 467, and in which a light chain variable region comprises, a light chain framework region (L-FR1) comprising an amino acid sequence selected from SEQ ID NOs: 486 to 491, a light chain framework region (L-FR2) comprising an amino acid sequence selected from SEQ ID NOs: 492 to 494, a light chain framework region (L-FR3) comprising an amino acid sequence selected from SEQ ID NOs: 495 to 500, and a light chain framework region (L-FR4) comprising an amino acid sequence selected from SEQ ID NOs: 501 to 503.

Preferably, the antibody or antigen binding fragment thereof according to an embodiment of the present invention comprises a heavy chain variable region comprising a heavy chain CDR1 to CDR3 comprising amino acid sequences of SEQ ID NOs: 434, 435 and 438, and a light chain variable region comprising a light chain CDR1 to CDR3 comprising amino acid sequences of SEQ ID NOs: 443, 444 and 445, in which the heavy chain variable region comprises, a heavy chain framework region (H-FR1) comprising an amino acid sequence of SEQ ID NO: 450, a heavy chain framework region (H-FR2) comprising an amino acid sequence of SEQ ID NO: 451, a heavy chain framework region (H-FR3) comprising an amino acid sequence selected from SEQ ID NOs: 462 to 464 and a heavy chain framework region (H-FR4) comprising an amino acid sequence of SEQ ID NO: 467, and the light chain variable region comprises, a light chain framework region (L-FR1) comprising an amino acid sequence of SEQ ID NO: 491, a light chain framework region (L-FR2) comprising an amino acid sequence of SEQ ID NO: 492, a light chain framework region (L-FR3) comprising an amino acid sequence of SEQ ID NO: 500, and a light chain framework region (L-FR4) comprising an amino acid sequence of SEQ ID NO: 501, The anti-alpha-synuclein antibody or antigen-binding fragment thereof according to an embodiment of the present invention comprises, a heavy chain variable region comprising a heavy chain CDR1 (H-CDR1) comprising an amino acid sequence of SEQ ID NO: 439, a heavy chain CDR2 (H-CDR2) comprising an amino acid sequence selected from SEQ ID NOs: 440 to 441, and a heavy chain CDR3 (H-CDR3) comprising an amino acid sequence of SEQ ID NO: 442. and a light chain variable region comprising a light chain CDR1 (L-CDR1) comprising an amino acid sequence of SEQ ID NO: 446, light chain CDR2 (L-CDR2) comprising an amino acid sequence of SEQ ID NO: 447, and a light chain CDR3 (L-CDR3) comprising an amino acid sequence of SEQ ID NO: 448, in which the heavy chain variable region comprises, a heavy chain framework region (H-FR1) comprising an amino acid sequence selected from SEQ ID NOs: 463 to 473, a heavy chain framework region (H-FR2) comprising an amino acid sequence selected from SEQ ID NOs: 474 to 477, a heavy chain framework region (H-FR3) comprising an amino acid sequence selected from SEQ ID NOs: 478 to 483, and a heavy chain framework region (H-FR4) comprising an amino acid sequence selected from SEQ ID NOs: 484 to 485, and in which the light chain variable region comprises, a light chain framework region (L-FR1) comprising an amino acid sequence selected from SEQ ID NOs: 504 to 510, a light chain framework region (L-FR2) comprising an amino acid sequence selected from SEQ ID NOs: 511 to 514, a light chain framework region (L-FR3) comprising an amino acid sequence selected from SEQ ID NOs: 515 to 521 and a light chain framework region (L-FR4) comprising an amino acid sequence of SEQ ID NO: 522.

In the full-length forms of light chain and heavy chain, the variable region and the constant region are joined by a "J" region of about 12 or more amino acids in length, and the heavy chain also includes a "D" region of about 10 or more amino acids in length. For example, Fundamental Immunology, 2nd ed., Ch. 7 (Paul, W., ed.) 1989, New York: Raven Press can be referred. Typically, the variable regions of the light chain and heavy chain pair in the antibody can form an antigen binding region.

The variable region of immunoglobulin chain has typically the same entire structure, and comprises the relatively-conserved framework region (FR) connected by three hypervariable regions called as "complementary determining region or domain" or CDR. The CDRs of the variable regions from each chain constituting the heavy chain/light chain pair are typically aligned by the framework regions, so as to form a structure specifically binding to a specific epitope of the target protein (alpha-synuclein). These elements of the naturally-occurring light chain variable region and heavy chain variable region are typically included in the following order from the N-terminus to the C-terminus: FR1, CDR1, FR2, CDR2, FR3, CDR3 and FR4. The position of the amino acid sequence corresponding to each of these elements in the variable region is designated according to the Kabat Numbering System (Kabat Sequences of Proteins of Immunological Interest), according to the disclosure of 1987 and 1991, NIH, Bethesda, MD)), or Chothia & Lesk, 1987, J. Mol. Biol. 196: 901-917; Chothia et al., 1989, Nature 342: 878-883.

Various heavy chain variable regions and light chain variable regions disclosed herein are shown in Tables 14 and 15. Each of these variable regions can be coupled to the heavy chain constant region and light chain constant region to form heavy chain and light chain of intact antibodies. In addition, the obtained heavy chain sequence and light chain sequence can also be combined to form a complete antibody structure. For example, the anti-alpha-synuclein antibody or antigen-binding fragment thereof according to the present invention, can include a heavy chain variable region comprising an amino acid sequence selected from SEQ ID NOs: 523 to 534 or SEQ ID NOs: 535 to 541, and a light chain variable region containing an amino acid sequence selected from SEQ ID NOs: 542 to 548 or SEQ ID NOs: 549 to 556, and more specifically, a heavy chain variable region comprising an amino acid sequence selected from SEQ ID NOs:523 to 534 and a light chain variable region comprising an amino acid sequence selected from SEQ ID NOs: 542 to 548, or a heavy chain variable region containing an amino acid sequence selected from SEQ ID NOs: 535 to 541 and a light chain variable region comprising an amino acid sequence selected from SEQ ID NOs: 549 to 556.

In a specific embodiment of the present invention, the anti-alpha-synuclein antibody or antigen-binding fragment thereof can include a heavy chain variable region comprising an amino acid sequence selected from SEQ ID NOs: 531 to 534 and a light chain variable region comprising an amino acid sequence of SEQ ID NO: 548 (e.g., Hu11F11 (ver.1), Hu11F11 (ver.2), Hu11F11 (ver.3), Hu11F11 (ver.4), etc.), or can include a heavy chain variable region comprising an amino acid sequence of SEQ ID NO: 525 and a light chain variable region comprising an amino acid sequence of SEQ ID NO: 546 (e.g., Hu11F11 (ABL2-4) antibody).

The amino acid sequences of the heavy chain variable region and the light chain variable region of the antibody or antigen-binding fragment according to an embodiment are exemplified in Tables 14 and 15.

TABLE 14

Heavy chain variable region (VH)

| Clone | SEQ ID NO: | Amino acid sequence |
|---|---|---|
| ch11F11-VH | 523 | EVQLQESGGGLVQPGGSLRLSCATSGFTFSDFYMEWVRQPPGKRL EWIAASRNKANDYTTEYSASVKGRFIVSRDTSQSILYLQMNALRAE DTAIYYCARDAHGKPFAYWGQGTLVTVSA |
| Hu11F11-VH1 | 524 | EVQLVESGGGLVQPGGSLRLSCAASGFTFSDFYMEWVRQAPGKGL EWIAAIRNKANDYTTEYAASVKGRFTVSRDTSKNSLYLQMNSLKT EDTAVYYCARDAHGKPFAYWGQGTLVTVSS |
| Hu11F11-VH2 | 525 | EVQLVESGGGLVQPGGSLRLSCAASGFTFSDFYMEWVRQAPGKGL EWIAAIRNKANDYTTEYAASVKGRFTISRDTSKNSLYLQMNSLKTE DTAVYYCARDAHGKPFAYWGQGTLVTVSS |
| Hu11F11-VH3 | 526 | EVQLVESGGGLVQPGGSLRLSCAASGFTFSDFYMEWVRQAPGKGL EWIAAIRNKANDYTTEYADSVKGRFTVSRDTSQNTLYLQMNSLRA EDTAVYYCARDAHGKPFAYWGQGTLVTVSS |
| Hu11F11-VH4 | 527 | EVQLVESGGGLVQPGGSLRLSCAASGFTFSDFYMEWVRQAPGKGL EWVAAIRNKANDYTTEYADSVKGRFTISADTSKNTAYLQMNSLR AEDTAVYYCSRDAHGKPFAYWGQGTLVTVSS |
| Hu11F11-VHv3 | 528 | EVQLVESGGGLVQPGGSLRLSCATSGFTFSDFYMEWVRQPPGKRL EWIAATRNKANDYTTEYSASVKGRFTISRDDSKSSLYLQMNSLRA EDTAIYYCARDAHGKPFAYWGQGTTVTVSS |
| Hu11F11-VHv1mu1 newmu | 529 | EVQLVESGGGLVQPGGSLRLSCATSGFTFSDFYMEWVRQPPGKRL EWIAATRNKANDYTTEYSASVKGRFTISRDTSQSSLYLQMNSLKTE DTAVYYCARDAHGKPFAYWGQGTTVTVSS |
| Hu11F11-VHv3 newmu | 530 | EVQLVESGGGLVQPGGSLRLSCATSGFTFSDFYMEWVRQPPGKRL EWIAATRNKANDYTTEYSASVKGRFTISRDTSQSSLYLQMNSLRAE DTAIYYCARDAHGKPFAYWGQGTTVTVSS |
| Hu11F11-VH-v1 | 531 | EVQLVESGGGLVQPGGSLRLSCATSGFTFSDFYMEWVRQPPGKRL EWIAASRNKANDYTTEYSASVKGRFTISRDDSKSSLYLQMNSLRA EDTAIYYCARDAHGKPFAYWGQGTTVTVSS |
| Hu11F11-VH-v2 | 532 | EVQLVESGGGLVQPGGSLRLSCATSGFTFSDFYMEWVRQPPGKRL EWIAASRNKANDYTTEYSASVKGRFTVSRDDSKSSLYLQMNSLRA EDTAIYYCARDAHGKPFAYWGQGTTVTVSS |
| Hu11F11-VH-v3 | 533 | EVQLVESGGGLVQPGGSLRLSCATSGFTFSDFYMEWVRQPPGKRL EWIAASRNKANDYTTEYSASVKGRFTISRDTSKSSLYLQMNSLRAE DTAIYYCARDAHGKPFAYWGQGTTVTVSS |

TABLE 14-continued

Heavy chain variable region (VH)

| Clone | SEQ ID NO: | Amino acid sequence |
|---|---|---|
| Hu11F11-VH-v4 | 534 | EVQLVESGGGLVQPGGSLRLSCATSGFTFSDFYMEWVRQPPGKRL EWIAASRNKANDYTTEYSASVKGRFTVSRDTSKSSLYLQMNSLRA EDTAIYYCARDAHGKPFAYWGQGTTVTVSS |
| ch3A9-VH | 535 | EVQLQESGGGLVKPGGSLKLSCAASGFTFSSYAMSWVRQTPEKRLEWVAT ISNGGGYTYYPDSVKGRFTISRDNAKNTLYLQMSSLRSEDTAMYYCARHIT TVRPTKYFDYWGQGTTLTVSS |
| Hu3A9-VH1 | 536 | QVQLLESGGGLVQPGGSLRLSCAASGFTFSSYAMSWVRQAPGKGLEWVA TISNGGGYTYYPDSVKGRFTISRDNAKNTLYLQMNSLRSEDSAMYYCARH ITTVRPTKYFDYWGQGTLVTVSS |
| Hu3A9-VH2 | 537 | EVQLVQSGGGLVQPGGSLRLSCAASGFTFSSYAMSWVRQAPDKGLEWVA TISNGGGYTYYADSVKGRFTISRDNAKNTLYLQMSSLKAEDSAVYYCARH ITTVRPTKYFDYWGQGTLVTVSS |
| Hu3A9-VH3 | 538 | EVQLVESGGGLVQPGGSLRLSCAASGFTFSSYAMSWVRQAPGKGLEWVA TISNGGGYTYYPDSVKGRFTISRDNSKNTLYLQMNSLRAEDTAVYYCARHI TTVRPTKYFDYWGQGTLVTVSS |
| Hu3A9-VH4 | 539 | EVQLVESGGGLVQPGGSLRLSCAASGFTFSSYAMSWVRQAPGKGLEWVA TISNGGGYTYYADSVKGRFTISADTSKNTAYLQMNSLRAEDTAVYYCARH ITTVRPTKYFDYWGQGTLVTVSS |
| Hu3A9-VH-v1 | 540 | EVQLLESGGGLVQPGGSLRLSCAASGFTFSSYAMSWVRQTPEKGLEWVAT ISNGGGYTYYPDSVKGRFTISRDNSKNTLYLQMSSLRAEDTAMYYCARHIT TVRPTKYFDYWGQGTTLTVSS |
| Hu3A9-VH-v2 | 541 | EVQLLESGGGLVKPGGSLKLSCAASGFTFSSYAMSWVRQTPEKGLEWVAT ISNGGGYTYYPDSVKGRFTISRDNSKNTLYLQMSSLRAEDTAMYYCARHIT TVRPTKYFDYWGQGTTLTVSS |
| ch9B11-VH | 557 | EVQLQESGGGLVQPKGSLKLSCAASGFTFNTYAMNWVRQA PGKGLEWVARIRSKSNNYATYYADSVKDRFTISRDDSQSMLY LQMNNLKTEDTAMYYCVRQDFDYWGQGTTLTVSS |

TABLE 15

Light chain variable region (VL)

| Clone | SEQ ID NO: | Amino acid sequence |
|---|---|---|
| ch11F11-VL | 542 | DIVMTQSPSSLAVSVGEKVTMSCKSSQSLLYSSNQKNYLAWYQQK PGQSPKLLIYWASTRESGVPDRFTGSGSGTDFTLTISSVKAEDLAVY YCQQYYSYPWTFGGGTKLEIK |
| Hu11F11-VL1 | 543 | DIVMTQSPDSLAVSLGERATINCKSSQSLLYSSNQKNYLAWYQQK PGQPPKLLIYWASTRESGVPDRFSGSGSGTDFTLTISSLQAEDVAVY YCQQYYSYPWTFGGGTKVEIK |
| Hu11F11-VL2 | 544 | DIVMTQSPSSLAVSLGERVTITCKSSQSLLYSSNQKNYLAWYQQKP GQPPKLLIYWASTRESGVPDRFSGSGSGTDFTLTISSVQAEDVAVY YCQQYYSYPWTFGGGTKLEIK |
| Hu11F11-VL3 | 545 | DIVMTQSPSSLAVSLGERATINCKSSQSLLYSSNQKNYLAWYQQKP GQPPKLLIYWASTRESGVPDRFSGSGSGTDFTLTISSLQAEDVAVY YCQQYYSYPWTFGGGTKLEIK |
| Hu11F11-VL4 | 546 | DIQMTQSPSSLSASVGDRVTITCKSSQSLLYSSNQKNYLAWYQQKP GKAPKLLIYWASTRESGVPSRFSGSGSGTDFTLTISSLQPEDFATYY CQQYYSYPWTFGQGTKVEIK |
| Hu11F11-VL5 | 547 | DIVMTQSPSSLAVSVGEKVTMSCKSSQSLLYSSNQKNYLAWYQQK PGQPPKLLIYWASTRESGVPDRFSGSGSGTDFTLTISSVQAEDVAVY YCQQYYSYPWTFGGGTKLEIK |
| Hu11F11-VLv34c | 548 | DIVMTQSPSSLAVSLGERVTMSCKSSQSLLYSSNQKNYLAWYQQK PGQSPKLLIYWASTRESGVPDRFTGSGSGTDFTLTISSVKAEDVAV YYCQQYYSYPWTFGGGTKLEIK |

TABLE 15-continued

Light chain variable region (VL)

| Clone | SEQ ID NO: | Amino acid sequence |
|---|---|---|
| ch3A9-VL | 549 | DIVMTQSPKFMSTSVGDRVSITCKASQNVGTTVAWYQQKPGQSPK LLIYSASNRYTGVPDRFTGSGSGTDFTLTISNMQSEDLADYFCQQY SNYPLTFGAGTKLELR |
| Hu3A9-VL1 | 550 | DIQMTQSPSSLSASVGDRVTITCKASQNVGTTVAWYQQKPGKAPK LLIYSASNRYTGVPDRFSGSGSGTDFTLTISSLQPEDFATYYCQQYS NYPLTFGGGTKLEIK |
| Hu3A9-VL2 | 551 | DIVMTQSPSTLSASVGDRVTITCKASQNVGTTVAWYQQKPGKAPK LLIYSASNRYTGVPSRFSGSGSGTEFTLTISSLQPDDFASYYCQQYS NYPLTFGQGTKVEIK |
| Hu3A9-VL3 | 552 | DIVMTQSPATLSVSLGERATLSCKASQNVGTTVAWYQQKPGQAPR LLIYSASNRYTGIPARFSGSGSGTEFTLTISSLQSEDFAVYYCQQYSN YPLTFGGGTKVEIK |
| Hu3A9-VL4 | 553 | DIQMTQSPSSLSA L SVGDRVTITCKASQNVGTTVAWYQQKPGKA PKLLIYSASNRYTGVPSRFSGSGSGTDFTLTISSLQPEDFATYYCQQ YSNYPLTFGQGTKVEIK |
| Hu3A9-VL-v1 | 554 | DIQMTQSPSSLSASVGDRVTITCKASQNVGTTVAWYQQKPGQSPK LLIYSASNRYTGVPDRFSGSGSGTDFTFTISSMQSEDIATYFCQQYS NYPLTFGQGTKLEIK |
| Hu3A9-VL-v2 | 555 | DIVMTQSPSSMSTSVGDRVTITCKASQNVGTTVAWYQQKPGQSPK LLIYSASNRYTGVPDRFSGSGSGTDFTLTISSMQSEDIADYYCQQYS NYPLTFGQGTKLEIK |
| Hu3A9-VL-v2 | 556 | DIVMTQSPSSMSTSVGDRVTITCKASQNVGTTVAWYQQKPGQSPK LLIYSASNRYTGVPDRFSGSGSGTDFTLTISSMQSEDLADYYCQQY SNYPLTFGQGTKLEIK |
| ch9B11-VL | 558 | DIVMTQSPLSLPVSLGDQASISCRSSQSLVHSNGNTYLHWYLQKPG QSPKLLIYKVSNRFSGVPDRFSGSGSGTDFTLKISRVEAEDLGVYFC SQSTHVPLTFGAGTKLEQKR |

In addition, the exemplified antibodies comprising a combination of a heavy chain variable region and a light chain variable region, and a constant region of an antibody or antigen-binding fragment according to an embodiment are described in Table 16.

TABLE 16

Exemplary antibodies of the present invention

| Sample Name | Chain | Amino acid sequence |
|---|---|---|
| hu1F11(ver.1) | heavy (SEQ ID NO: 560) | EVQLVESGGGLVQPGGSLRLSCATSGFTFSDFYMEWVRQPPGKRLEWIA ASRNKANDYTTEYSASVKGRFTISRDDSKSSLYLQMNSLRAEDTAIYYCA RDAHGKPFAYWGQGTTVTVSSASTKGPSVFPLAPSSKSTSGGTAALGCLV KDYFPEPVTVSWNSGALTSGVHTFPAVLQSSGLYSLSSVVTVPSSSLGTQT YICNVNHKPSNTKVDKKVEPKSCDKTHTCPPCPAPELLGGPSVFLFPPKPK DTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPRE PQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLS PGK |
| | light (SEQ ID NO: 566) | DIVMTQSPSSLAVSLGERVTMSCKSSQSLLYSSNQKNYLAWYQQKPGQS PKLLIYWASTRESGVPDRFTGSGSGTDFTLTISSVKAEDVAVYYCQQYS YPWTFGGGTKLEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| hu1F11(ver.2) | heavy (SEQ ID NO: 561) | EVQLVESGGGLVQPGGSLRLSCATSGFTFSDFYMEWVRQPPGKRLEWIA ASRNKANDYTTEYSASVKGRFTVSRDDSKSSLYLQMNSLRAEDTAIYYC ARDAHGKPFAYWGQGTTVTVSSASTKGPSVFPLAPSSKSTSGGTAALGCL VKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPK PKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTT |

TABLE 16-continued

Exemplary antibodies of the present invention

| Sample Name | Chain | Amino acid sequence |
|---|---|---|
| | | PPVLDSDGSFFLYSKLTVDKSRWQQGNVFSCSVMHEALHNHYTQKSLSL SPGK |
| | light (SEQ ID NO: 566) | DIVMTQSPSSLAVSLGERVTMSCKSSQSLLYSSNQKNYLAWYQQKPGQS PKLLIYWASTRESGVPDRFTGSGSGTDFTLTISSVKAEDVAVYYCQQYYS YPWTFGGGTKLEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| hu11F11(ver.3) | heavy (SEQ ID NO: 562) | EVQLVESGGGLVQPGGSLRLSCATSGFTFSDFYMEWVRQPPGKRLEWIA ASRNKANDYTTEYSASVKGRFTISRDTSKSSLYLQMNSLRAEDTAIYYCA RDAHGKPFAYWGQGTTVTVSSASTKGPSVFPLAPSSKSTSGGTAALGCLV KDYFPEPVTVSWNSGALTSGVHTFPAVLQSSGLYSLSSVVTVPSSSLGTQT YICNVNHKPSNTKVDKKVEPKSCDKTHTCPPCPAPELLGGPSVFLFPPKPK DTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPRE PQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLS PGK |
| | light (SEQ ID NO: 566) | DIVMTQSPSSLAVSLGERVTMSCKSSQSLLYSSNQKNYLAWYQQKPGQS PKLLIYWASTRESGVPDRFTGSGSGTDFTLTISSVKAEDVAVYYCQQYYS YPWTFGGGTKLEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| hu11F11(ver.4) | heavy (SEQ ID NO: 563) | EVQLVESGGGLVQPGGSLRLSCATSGFTFSDFYMEWVRQPPGKRLEWIA ASRNKANDYTTEYSASVKGRFTVSRDTSKSSLYLQMNSLRAEDTAIYYC ARDAHGKPFAYWGQGTTVTVSSASTKGPSVFPLAPSSKSTSGGTAALGCL VKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPK PKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTT PPVLDSDGSFFLYSKLTVDKSRWQQGNVFSCSVMHEALHNHYTQKSLSL SPGK |
| | light (SEQ ID NO: 566) | DIVMTQSPSSLAVSLGERVTMSCKSSQSLLYSSNQKNYLAWYQQKPGQS PKLLIYWASTRESGVPDRFTGSGSGTDFTLTISSVKAEDVAVYYCQQYYS YPWTFGGGTKLEIKRTVAAPSVFIFPPSDEQLKSGTASVVCLLNNFYPREA KVQWKVDNALQSGNSQESVTEQDSKDSTYSLSSTLTLSKADYEKHKVYA CEVTHQGLSSPVTKSFNRGEC |
| hu11F11(H2L4) | Heavy (SEQ ID NO: 564) | EVQLVESGGGLVQPGGSLRLSCAASGFTFSDFYMEWVRQAPGKGLEWIA AIRNKANDYTTEYAASVKGRFTISRDTSKNSLYLQMNSLKTEDTAVYYC ARDAHGKPFAYWGQGTLVTVSSASTKGPSVFPLAPSSKSTSGGTAALGCL VKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPK PKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTT PPVLDSDGSFFLYSKLTVDKSRWQQGNVFSCSVMHEALHNHYTQKSLSL SPGK |
| | light (SEQ ID NO: 567) | DIQMTQSPSSLSASVGDRVTITCKSSQSLLYSSNQKNYLAWYQQKPGKAP KLLIYWASTRESGVPSRFSGSGSGTDFTLTISSLQPEDFATYYCQQYYSYP WTFGQGTKVEIKRTVAAPSVFIFPPSDEQLKSGTASVVCLLNNFYPREAK VQWKVDNALQSGNSQESVTEQDSKDSTYSLSSTLTLSKADYEKHKVYAC EVTHQGLSSPVTKSFNRGEC |
| hu3A9(VH5/L3) | heavy (SEQ ID NO: 565) | EVQLQESGGGLVKPGGSLKLSCAASGFTFSSYAMSWVRQTPEKGLEWVA TISNGGGYTYYPDSVKGRFTISRDNAKNTLYLQMNSLRSEDTAVYYCAR HITTVRPTKYFDYWGQGTLVTVSSASTKGPSVFPLAPSSKSTSGGTAALG CLVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKG QPREPQVYTLPPSREEMTKNQVSLTCLVKGFYPSDIAVEWESNGQPENNY KTTPPVLDSDGSFFLYSKLTVDKSRWQQGNVFSCSVMHEALHNHYTQKS LSLSPGK |
| | light (SEQ ID NO: 568) | DIVMTQSPATLSVSLGERATLSCKASQNVGTTVAWYQQKPGQAPRLLIYS ASNRYTGIPARFSGSGSGTEFTLTISSLQSEDFAVYYCQQYSNYPLTFGGG TKVEIKRTVAAPSVFIFPPSDEQLKSGTASVVCLLNNFYPREAKVQWKVD NALQSGNSQESVTEQDSKDSTYSLSSTLTLSKADYEKHKVYACEVTHQG LSSPVTKSFNRGEC |

In order that the heavy chain variable region and the light chain variable region described herein form the heavy chain and the light chain of the intact antibody, each heavy chain variable region and the light chain variable region may be bound to the heavy chain constant region and the light chain constant region. Each of heavy chain and light chain which are produced as described above can combine properly to constitute the combination of heavy chain-light chain, and the combination of heavy chain-light chain can form the multimer (for example, dimer for IgG type antibody), resulting in construction of the intact antibody structure.

The constant region may be appropriately selected from heavy and light chain constant regions of immunoglobulins (e.g., human immunoglobulins). For example, the heavy chain constant region may be an IgG1 heavy chain constant region, an IgG3 heavy chain constant region, or an IgG4 heavy chain constant region, and the light chain constant region may be a kappa constant region or a lambda constant region, but is not limited thereto. Other types of the constant regions or modified constant regions may be appropriately selected and used for antibody stability, manufacturability, antigen affinity, and/or other desired characteristics, which are clearly understood by those skilled in the art.

In another embodiment, each of the heavy chain variable regions and the light chain variable regions disclosed in Tables 14 and 15 can be freely combined with each other to form various antibodies, and are linked in a single chain form to produce single chain antibodies such as scFv.

The antibody described herein may share a specific region or sequence with a different antibody disclosed herein. In an embodiment, the antibody may share the constant region of the other antibody or antigen-binding fragment thereof. In another embodiment, it may share an Fc region.

In an embodiment, the anti-alpha-synuclein antibody of the present invention also includes a monoclonal antibody and a polyclonal antibody. In another embodiment, the anti-alpha-synuclein antibody may be a human antibody, a humanized antibody, a chimeric antibody or an antibody driven from animal. In another embodiment, the anti-alpha-synuclein antibody can be prepared recombinantly or chemically synthesized.

The antigen-binding fragments or antibody fragments of antibodies described herein may be at least one selected from the group consisting of the single chain antibody molecules of scFv, (scFv)$_2$, scFv-Fc, Fab, Fab', F(ab')$_2$, minibody, diabody, scFv and the like.

In another embodiment, the antibody provided herein may be a humanized antibody or human antibody and may be various isotypes (for examples, IgA, IgG1, IgG2, IgG3, IgG4, IgE, or IgD), particularly IgG1-, IgG2-IgG3- or IgG4-type, such as IgG1- or IgG2-types.

In another embodiment, the anti-alpha-synuclein antibody may comprise only heavy chain or light chain described above. In another embodiment, the anti-alpha-synuclein antibody has only heavy chain variable region or only light chain variable region.

Those skilled in the art will understand that when an antibody comprises one or more CDRs disclosed herein, each of the CDRs disclosed may be independently selected from each other and combined. Therefore, the antibodies can be prepared to include 1, 2, 3, 4, 5, or 6 of CDRs selected independently. It will also be understood by those skilled in the art that when a CDR is selected for combination, the same kind of CDR is not used repeatedly, and for example, an antibody is generally not produced to include two CDR-H2 regions.

In an embodiment, the antibody may be a monoclonal antibody or polyclonal antibody. The antibodies disclosed herein include monoclonal antibodies binding to alpha-synuclein. The monoclonal antibodies can be produced by using any technique known in the art. For example, they can be produced by immortalizing spleen cells harvested from immunized transgenic animals. The monoclonal antibodies secreted by hybridoma cell lines can be purified using techniques known in the art.

In other embodiments, the antibody may be an animal-derived antibody (e.g., mouse antibody, etc.), a chimeric antibody (e.g., mouse-human chimeric antibody), a humanized antibody, or a human antibody. The antibody can also be modified in a various ways for various purposes. The chimeric antibodies and the humanized antibodies are also provided. The chimeric antibodies are antibodies in which polypeptide fragments derived from different antibodies are covalently linked to form an immunologically-functional light chain, heavy chain, or fragment thereof.

In such a monoclonal antibody, a specific amino acid residue, which typically constitutes the non-antigen recognition portion of the antibody, is modified to be homologous to the corresponding residue of the isotype corresponding to the human antibody. Humanization can be performed with various known methods, for example, substituting at least a portion of the rodent variable region with the corresponding region of a human antibody (U.S. Pat. Nos. 5,585,089 and 5,693,762; Jones et al., Nature 1986, 321: 522-525; Riechmann et al., Nature 1988, 332: 323-27; Verhoeyen et al., Science 1988, 239: 1534-1536).

The complete human antibody may be produced by immunizing a transgenic animal (commonly, mouse) which can produce a human antibody by lacking production of an endogenous immunoglobulin. The complete human antibody may be also derived from a phage display library. If the complete human antibodies are used, it can minimize the immunogenic and allergic reactions that can be caused by administration of a mouse or mouse-derived mAb to humans.

In an embodiment, the human alpha-synuclein antibodies of the present invention are selected through the phage display method. The monoclonal phage antibodies specific to alpha-synuclein which are selected through phage screening method, are inverted into full IgG form by using the recombinant method. The sequence of each monoclonal phage antibody is obtained for recombinantly producing anti-alpha-synuclein antibodies. After linking the heavy chain variable region sequence to the heavy chain constant region sequence and the light chain variable region sequence to the light chain constant region sequence in the obtained sequences, the amino acid sequences are converted into nucleotide sequences with the codon optimization method. After the obtained nucleotide sequences are cloned into vectors used for animal cell culture, the host cells used for protein production such as CHO cells are transformed with the vectors and cultured. In order to purify the antibodies contained in the culture medium, the recombinant antibodies are separated and purified using a purification technique such as affinity chromatography.

In other embodiments, the antibody can have a typical structure of a naturally-occurring antibody, or modified structure.

The antibody having the typical structure may have a multimeric structure including structural units comprising two different polypeptide chains (i.e., heavy chain and light chain). The two different polypeptide chains comprise one full-length light chain (about 25 kDa) and one full-length heavy chain (about 50 to 70 kDa). Each chain shows a characteristic folding pattern, and consists of several immunoglobulin domains, consisting of about 90 to 110 amino acids. These domains are basic units consisting of an antibody polypeptide. The amino-terminal part of each chain typically comprises a part called a variable region or V region that is a part recognizing an antigen. The carboxy-terminal part is conserved evolutionarily more than the amino-terminal, and it comprises a part called a constant region or C region. The human light chain is commonly classified as kappa (κ) and lambda (λ) light chains, and these comprise one variable region and one constant region. The heavy chain is typically classified as mu ( ), delta (6), gamma (γ), alpha (a) or epsilon (F) chain, and these are defined as IgM, IgD, IgG, IgA and IgE isotypes, respectively. IgG includes IgG1, IgG2, IgG3 and IgG4, but unlimited numerous subtypes without limited thereto. The heavy chain constant region includes typically one or more domains showing an effector function. The number of the domains in heavy chain constant region varies depending on the isotypes. IgG heavy chain, for example, comprises three C region domains known as CH1, CH2 and CH3, respectively. The antibody disclosed herein may be any one of these isotypes and subtypes. In one embodiment, the antibody of the present invention is an IgG1, IgG2, IgG2a, IgG2b, IgG3 or IgG4 subtypes.

The alpha-synuclein aggregate according to the present application specifically recognizes the alpha-synuclein aggregate with high affinity and specificity, and indicates that the alpha-synuclein antibody can be useful for diagnosis or detection of such diseases. Furthermore, the alpha-synuclein antibody specifically recognizing the alpha-synuclein aggregate according to the present application inhibits the formation of alpha-synuclein aggregates, degrades the aggregates, or inhibits the intercellular transfer of aggregates, thereby being usefully used for treating synucleinopathies, particularly Parkinson's disease.

Examples of bispecific antibodies of the present invention are shown in Table 17

TABLE 17

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| ch11F11-1564-3 bivalent | ch11F11-VL | ch11F11-1564-3 bivalent (HC) | 569 | CH11F11 (IGG)-(G4S)3-1564-3 VL-(G4S)4-1564-3 VH | 640 412 297 411 178 |
| ch11F11-1564-2 bivalent | ch11F11-VL | ch11F11-1564-2 bivalent (HC) | 570 | CH11F11 (IGG), (G4S)3, 1564-2 VL, (G4S)4, 1564-2 VH | 640 412 296 411 177 |
| ch11F11-1564-3 monovalent | ch11F11-VL | ch11F11-1564-3 monovalent (HC 1, -hole) (1564-3 scFv) | 571 | CH11F11 (IGG) WITH HOLE MUTATION AT FC, (G4S)3, 1564-3 VL, (G4S)4, 1564-3 VH | 641 412 297 411 178 |
| | | ch11F11-1564 monovalent (HC 2, -knob) | 573 | CH11F11 (IGG) WITH KNOB MUTATION | 573 |
| ch11F11-1564-2 monovalent | ch11F11-VL | ch11F11-1564-2 monovalent (HC 1, -hole) (1564-2 scFv) | 572 | CH11F11 (IGG) WITH HOLE MUTATION AT FC, (G4S)3, 1564-2 VL, (G4S)4, 1564-2 VH | 641 412 296 411 177 |
| | | ch11F11-1564 monovalent (HC 2, -knob) | 573 | CH11F11 (IGG) WITH KNOB MUTATION | 573 |
| ch3A9-1564-3 bivalent | ch3A9-VL | ch3A9-1564-3 bivalent (HC) | 574 | CH3A9 (IGG), (G4S)3, 1564-3 VL, (G4S)4, 1564-3 VH | 642 412 297 411 178 |
| ch3A9-1564-2 bivalent | ch3A9-VL | ch3A9-1564-2 bivalent (HC) | 575 | CH3A9 (IGG), (G4S)3, 1564-2 VL, (G4S)4, 1564-2 VH | 642 412 296 411 177 |
| ch3A9-1564-3 monovalent | ch3A9-VL | ch3A9-1564-3 monovalent (HC 1, -hole) | 576 | CH3A9 (IGG) WITH HOLE MUTATION AT FC (G4S)3, 1564-3 VL, (G4S)4, 1564-3 VH | 643 412 297 411 178 |
| | | ch3A9-1564 monovalent (HC 2, -knob) | 578 | CH3A9 (IGG) WITH KNOB MUTATION | 578 |

TABLE 17-continued

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| ch3A9-1564-3 monovalent | ch3A9-VL | ch3A9-1564-2 monovalent (HC 1, -hole) | 577 | CH3A9 (IGG) WITH HOLE MUTATION AT FC, | 643 |
| | | | | (G4S)3, | 412 |
| | | | | 1564-2 VL, | 296 |
| | | | | (G4S)4, | 411 |
| | | | | 1564-2 VH | 177 |
| | | ch3A9-1564 monovalent (HC 2, -knob) | 578 | CH3A9 (IGG) WITH KNOB MUTATION | 578 |
| hu11F11(ver.2)-1564-3 bivalent | Hu11F11-VLv3 4c | hu11F11(ver.2)-1564-3 bivalent (HC) | 579 | hu11F11(ver.2 (IGG), | 644 |
| | | | | (G4S)3, | 412 |
| | | | | 1564-3 VL, | 297 |
| | | | | (G4S)4, | 411 |
| | | | | 1564-3 VH | 178 |
| hu11F11(ver.2)-1564-2 bivalent | Hu11F11-VLv3 4c | hu11F11(ver.2)-1564-2 bivalent (HC) | 580 | hu11F11(ver.2 (IGG), | 644 |
| | | | | (G4S)3, | 412 |
| | | | | 1564-2 VL, | 296 |
| | | | | (G4S)4, | 411 |
| | | | | 1564-2 VH | 177 |
| hu11F11(ver.2)-1564-3 monovalent | Hu11F11-VLv3 4c | hu11F11(ver.2)-1564-3 monovalent (HC 1, -hole) | 581 | hu11F11(ver.2 (IGG) WITH HOLE MUTATION AT FC, | 645 |
| | | | | (G4S)3, | 412 |
| | | | | 1564-3 VL, | 297 |
| | | | | (G4S)4, | 411 |
| | | | | 1564-3 VH | 178 |
| | | hu11F11(ver.2)-1564 monovalent (HC 2, -knob) | 583 | hu11F11(ver.2 (IGG) WITH KNOB MUTATION | 583 |
| hu11F11(ver.2)-1564-2 monovalent | Hu11F11-VLv3 4c | hu11F11(ver.2)-1564-2 monovalent (HC 1, -hole) | 582 | hu11F11(ver.2 (IGG) WITH HOLE MUTATION AT FC, | 645 |
| | | | | (G4S)3, | 412 |
| | | | | 1564-2 VL, | 296 |
| | | | | (G4S)4, | 411 |
| | | | | 1564-2 VH | 177 |
| | | hu11F11(ver.2)-1564 monovalent (HC 2, -knob) | 583 | hu11F11(ver.2 (IGG) WITH KNOB MUTATION | 583 |
| ** | | human IgG1 M428L mutated (CH1, CH2, CH3) | 584 | HUMAN IGG1 M428L MUTATION AT FC | 584 |
| hu11F11(ver.2)(M428L)-1564-DMP bivalent | Hu11F11-VLv3 4c | hu11F11(ver.2)(M428L)-1564-DMP bivalent(HC) | 585 | hu11F11(ver.2 (IGG), M428L MUTATION, | 646 |
| | | | | (G4S)3, | 412 |
| | | | | 1564-DMP VL, | 299 |
| | | | | (G4S)4, | 411 |
| | | | | 1564-DMP VH | 180 |
| hu11F11(ver.2)(M428L)-1564-DM bivalent | Hu11F11-VLv3 4c | hu11F11(ver.2)(M428L)-1564-DM bivalen t(HC) | 586 | hu11F11(ver.2 (IGG), M428L MUTATION, | 646 |
| | | | | (G4S)3, | 412 |
| | | | | 1564-DM VL, | 298 |
| | | | | (G4S)4, | 411 |
| | | | | 1564-DM VH | 179 |
| hu11F11(ver.2)(M428L)-1564-DMP monovalent | Hu11F11-VLv3 4c | hu11F11(ver.2)(M428L)-1564-DMP monovalent (HC 1, -hole) | 587 | hu11F11(ver.2 (IGG), M428L, HOLE MUTATION, | 647 |
| | | | | (G4S)3, | 412 |
| | | | | 1564-DMP VL, | 299 |
| | | | | (G4S)4, | 411 |
| | | | | 1564-DMP VH | 180 |
| | | hu11F11(ver.2)(M428L)-1564 monovalent, (HC 2, -knob) | 589 | hu11F11(ver.2 (IGG), M428L, KNOB MUTATION | 589 |
| hu11F11(ver.2)(M428L)-1564-DM monovalent | Hu11F11-VLv3 4c | hu11F11(ver.2)(M428L)-1564-DMP monovalent, (HC 1, -hole) | 588 | hu11F11(ver.2 (IGG), M428L, HOLE MUTATION, | 647 |
| | | | | (G4S)3, | 412 |
| | | | | 1564-DM VL, | 298 |
| | | | | (G4S)4, | 411 |
| | | | | 1564-DM VH | 179 |
| | | hu11F11(ver.2)(M428L)-1564 monovalent, (HC 2, -knob) | 589 | hu11F11(ver.2 (IGG), M428L, KNOB MUTATION | 589 |

TABLE 17-continued

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| hu11F11(ver.2)-C04-3 monovalent | Hu11F11-VLv3 4c | hu11F11(ver.2)-C04-3 monovalent (HC 1, -hole) | 590 | hu11F11(ver.2 (IGG), HOLE MUTATION, (G4S)3, C04-3 VL, (G4S)4, C04-3 VH | 645 412 334 411 215 |
|  |  | hu11F11(ver.2)-C04 monovalent (HC 2, -knob) | 583 | hu11F11(ver.2 (IGG), KNOB MUTATION | 583 |
| hu11F11(ver.2)-C04-2 monovalent | Hu11F11-VLv3 4c | hu11F11(ver.2)-C04-2 monovalent (HC 2, -knob) | 591 | hu11F11(ver.2 (IGG), KNOB MUTATION (G4S)3, C04-2 VL, (G4S)4, C04-2 VH | 645 412 333 411 214 |
|  |  | hu11F11(ver.2)-C04 monovalent (HC 2, -knob) | 583 | hu11F11(ver.2 (IGG), KNOB MUTATION | 583 |
| hu11F11(ver.2)-F06-03 monovalent |  | hu11F11(ver.2)-F06-3 monovalent (HC 1, -hole) | 592 | hu11F11(ver.2 (IGG), HOLE MUTATION, (G4S)3, F06-3 VL, (G4S)4, F06-3 VH | 645 412 339 411 220 |
|  |  | hu11F11(ver.2)-C04 monovalent (HC 2, -knob) | 583 | hu11F11(ver.2 (IGG), KNOB MUTATION | 583 |
| hu11F11(ver.2)-F06-02 monovalent | Hu11F11-VLv3 4c | hu11F11(ver.2)-F06-02 monovalent (HC 1, -hole) | 593 | hu11F11(ver.2 (IGG), HOLE MUTATION, (G4S)3, F06-2 VL, (G4S)4, F06-2 VH | 645 412 338 411 219 |
|  |  | hu11F11(ver.2)-C04 monovalent (HC 2, -knob) | 583 | hu11F11(ver.2 (IGG), KNOB MUTATION | 583 |
| hu11F11(ver.2)-VH2-3 bivalent | Hu11F11-VLv3 4c | hu11F11(ver.2)-VH2-3 bivalent (HC) | 594 | hu11F11(ver.2 (IGG), (G4S)3, VH2-3 VL, (G4S)4, VH2-3 VH | 644 412 356 411 237 |
| hu11F11(ver.2)-VH2-2 bivalent | Hu11F11-VLv3 4c | hu11F11(ver.2)-VH2-2 bivalent (HC)_2 | 595 | hu11F11(ver.2 (IGG), (G4S)3, VH2-2 VL, (G4S)4, VH2-2 VH | 644 412 355 411 236 |
| hu11F11(ver.2)-VH5-3 bivalent | Hu11F11-VLv3 4c | hu11F11(ver.2)-VH5-3 bivalent (HC) | 596 | hu11F11(ver.2 (IGG), (G4S)3, VH5-3 VL, (G4S)4, VH5-3 VH | 644 412 361 411 242 |
| hu11F11(ver.2)-VH5-2 bivalent | Hu11F11-VLv3 4c | hu11F11(ver.2)-VH5-2 bivalent (HC)_2 | 597 | hu11F11(ver.2 (IGG), (G4S)3, VH5-2 VL, (G4S)4, VH5-2 VH | 644 412 360 411 241 |
| hu11F11(ver.2)-VH6-3 bivalent | Hu11F11-VLv3 4c | hu11F11(ver.2)-VH6-3 bivalent (HC) | 598 | hu11F11(ver.2 (IGG), (G4S)3, VH6-3 VL, (G4S)4, VH6-3 VH | 644 412 366 411 247 |
| hu11F11(ver.2)-VH6-2 bivalent | Hu11F11-VLv3 4c | hu11F11(ver.2)-VH6-2 bivalent (HC)_2 | 599 | hu11F11(ver.2 (IGG), (G4S)3, VH6-2 VL, (G4S)4, VH6-2 VH | 644 412 365 411 246 |
| hu11F11(ver.2)-VH7-3 bivalent | Hu11F11-VLv3 4c | hu11F11(ver.2)-VH7-3 bivalent (HC) | 600 | hu11F11(ver.2 (IGG), (G4S)3, VH7-3 VL, (G4S)4, VH7-3 VH | 644 412 371 411 252 |
| hu11F11(ver.2)-VH7-2 bivalent | Hu11F11-VLv3 4c | hu11F11(ver.2)-VH7-2 bivalent (HC)_2 | 601 | hu11F11(ver.2 (IGG), (G4S)3, VH7-2 VL, (G4S)4, VH7-2 VH | 644 412 370 411 251 |

TABLE 17-continued

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| hu11F11(ver.2)-VH9-3 bivalent | Hu11F11-VLv3 4c | hu11F11(ver.2)-VH9 bivalent (HC) | 602 | hu11F11(ver.2 (IGG), (G4S)3, VH9-3 VL, (G4S)4, VH9-3 VH | 644 412 376 411 257 |
| hu11F11(ver.2)-VH9-2 bivalent | Hu11F11-VLv3 4c | hu11F11(ver.2)-VH9 bivalent (HC)_2 | 603 | hu11F11(ver.2 (IGG), (G4S)3, VH9-2 VL, (G4S)4, VH9-2 VH | 644 412 375 411 256 |
| hu11F11(ver.2)-VH16-3 bivalent | Hu11F11-VLv3 4c | hu11F11(ver.2)-VH16 bivalent (HC) | 604 | hu11F11(ver.2 (IGG), (G4S)3, VH16-3 VL, (G4S)4, VH16-3 VH | 644 412 381 411 262 |
| hu11F11(ver.2)-VH16-2 bivalent | Hu11F11-VLv3 4c | hu11F11(ver.2)-VH16 bivalent (HC)_2 | 605 | hu11F11(ver.2 (IGG), (G4S)3, VH16-2 VL, (G4S)4, VH16-2 VH | 644 412 380 411 262 |
| hu11F11(ver.2)-VH27 -3 bivalent | Hu11F11-VLv3 4c | hu11F11(ver.2)-VH27 bivalent (HC) | 606 | hu11F11(ver.2 (IGG), (G4S)3, VH27-3 VL, (G4S)4, VH27-3 VH | 644 412 386 411 267 |
| hu11F11(ver.2)-VH27-2 bivalent | Hu11F11-VLv3 4c | hu11F11(ver.2)-VH27 bivalent (HC)_2 | 607 | hu11F11(ver.2 (IGG), (G4S)3, VH27-2 VL, (G4S)4, VH27-2 VH | 644 412 385 411 266 |
| hu11F11(ver.2)-VH32-3 bivalent | Hu11F11-VLv3 4c | hu11F11(ver.2)-VH32 bivalent (HC) | 608 | hu11F11(ver.2 (IGG), (G4S)3, VH32-3 VL, (G4S)4, VH32-3 VH | 644 412 391 411 272 |
| hu11F11(ver.2)-VH32-2 bivalent | Hu11F11-VLv3 4c | hu11F11(ver.2)-VH32 bivalent (HC)_2 | 609 | hu11F11(ver.2 (IGG), (G4S)3, VH32-2 VL, (G4S)4, VH32-2 VH | 644 412 390 411 271 |
| hu11F11(ver.2)-VH35-3 bivalent | Hu11F11-VLv3 4c | hu11F11(ver.2)-VH35 bivalent (HC) | 610 | hu11F11(ver.2 (IGG), (G4S)3, VH35-3 VL, (G4S)4, VH35-3 VH | 644 412 396 411 277 |
| hu11F11(ver.2)-VH35-2 bivalent | Hu11F11-VLv3 4c | hu11F11(ver.2)-VH35 bivalent (HC)_2 | 611 | hu11F11(ver.2 (IGG), (G4S)3, VH35-2 VL, (G4S)4, VH35-2 VH | 644 412 395 411 276 |
| hu11F11(ver.2)(M428L)-C04-DMP monovalent | Hu11F11-VLv3 4c | hu11F11(ver.2)(M428L)-C04-DMP monovalent (HC 1, -hole) | 612 | hu11F11(ver.2 (IGG), M428L, HOLE MUTATION, (G4S)3, C04-DMP VL, (G4S)4, C04-DMP VH | 647 412 336 411 217 |
|  |  | hu11F11(ver.2)(M428L)-C04 (HC 2, -knob) | 589 | hu11F11(ver.2 (IGG), M428L MUTATION, KNOB MUTATION | 589 |
| hu11F11(ver.2)(M428L)-C04-DM monovalent | Hu11F11-VLv3 4c | hu11F11(ver.2)(M428L)-C04-DM monovalent (HC 1, -hole) | 613 | hu11F11(ver.2 (IGG), M428L, HOLE MUTATION, (G4S)3, C04-DM VL, (G4S)4, C04-DM VH | 647 412 335 411 216 |
|  |  | hu11F11(ver.2)(M428L)-C04 (HC 2, -knob) | 589 | hu11F11(ver.2 (IGG), M428L MUTATION, KNOB MUTATION | 589 |
| hu11F11(ver.2)(M428L)-F06-DMP monovalent | Hu11F11-VLv3 4c | hu11F11(ver.2)(M428L)-F06-DMP monovalent (HC 1, -hole) | 614 | hu11F11(ver.2 (IGG), M428L, HOLE MUTATION, (G4S)3, F06-DMP VL, | 647 412 341 |

TABLE 17-continued

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| | | | | (G4S)4, | 411 |
| | | | | F06-DMP VH | 222 |
| | | hu11F11(ver.2)(M428L)-F06 monovalent (HC 2, -knob) | 589 | hu11F11(ver.2 (IGG),M428L MUTATION, KNOB MUTATION | 589 |
| hu11F11(ver.2)(M428L)-F06-DM monovalent | Hu11F11-VLv3 4c | hu11F11(ver.2)(M428L)-F06-DM monovalent (HC 1, -hole) | 615 | hu11F11(ver.2 (IGG), M428L, HOLE MUTATION, | 647 |
| | | | | (G4S)3, | 412 |
| | | | | F06-DM VL, | 340 |
| | | | | (G4S)4, | 411 |
| | | | | F06-DM VH | 221 |
| | | hu11F11(ver.2)(M428L)-F06 monovalent, deamidated, S->P (HC 2, -knob) | 589 | hu11F11(ver.2 (IGG),M428L MUTATION, KNOB MUTATION | 589 |
| hu11F11(ver.2)(M428L)-VH2-DMP bivalent | Hu11F11-VLv3 4c | hu11F11(ver.2)(M428L)-VH2-DMP bivalent (HC) | 616 | hu11F11(ver.2 (IGG), M428L MUTATION, | 646 |
| | | | | (G4S)3, | 412 |
| | | | | VH2-DMP VL, | 358 |
| | | | | (G4S)4, | 411 |
| | | | | VH2-DMP VH | 239 |
| hu11F11(ver.2)(M428L)-VH2-DM bivalent | Hu11F11-VLv3 4c | hu11F11(ver.2)(M428L)-VH2-DM bivalent (HC) | 617 | hu11F11(ver.2 (IGG), M428L MUTATION, | 646 |
| | | | | (G4S)3, | 412 |
| | | | | VH2-DM VL, | 357 |
| | | | | (G4S)4, | 411 |
| | | | | VH2-DM VH | 238 |
| hu11F11(ver.2)(M428L)-VH5-DMP bivalent (HC) | Hu11F11-VLv3 4c | hu11F11(ver.2)(M428L)-VH5-DMP bivalent (HC) | 618 | hu11F11(ver.2 (IGG), M428L MUTATION, | 646 |
| | | | | (G4S)3, | 412 |
| | | | | VH5-DMP VL, | 363 |
| | | | | (G4S)4, | 411 |
| | | | | VH5-DMP VH | 244 |
| hu11F11(ver.2)(M428L)-VH5-DM bivalent (HC) | Hu11F11-VLv3 4c | hu11F11(ver.2)(M428L)-VH5-DM bivalent (HC) | 619 | hu11F11(ver.2 (IGG), M428L MUTATION, | 646 |
| | | | | (G4S)3, | 412 |
| | | | | VH5-DM VL, | 362 |
| | | | | (G4S)4, | 411 |
| | | | | VH5-DM VH | 243 |
| hu11F11(ver.2)(M428L)-VH5-DMP monovalent | Hu11F11-VLv3 4c | hu11F11(ver.2)(M428L)-VH5-DMP monovalent, (HC 1, -hole) | 620 | hu11F11(ver.2 (IGG), M428L, HOLE MUTATION, | 647 |
| | | | | (G4S)3, | 412 |
| | | | | VH5-DMP VL, | 363 |
| | | | | (G4S)4, | 411 |
| | | | | VH5-DMP VH | 244 |
| | | hu11F11(ver.2)(M428L)-VH5 monovalent, deamidated, S->P (HC 2, -knob) | 589 | hu11F11(ver.2 (IGG),M428L MUTATION, KNOB MUTATION | 589 |
| hu11F11(ver.2)(M428L)-VH5_DM monovalent | Hu11F11-VLv3 4c | hu11F11(ver.2)(M428L)-VH5_DM monovalent, (HC 1, -hole) | 621 | hu11F11(ver.2 (IGG), M428L, HOLE MUTATION, | 647 |
| | | | | (G4S)3, | 412 |
| | | | | VH5-DM VL, | 362 |
| | | | | (G4S)4, | 411 |
| | | | | VH5-DM VH | 243 |
| | | hu11F11(ver.2)(M428L)-VH5 monovalent, deamidated, S->P (HC 2, -knob) | 589 | hu11F11(ver.2 (IGG),M428L MUTATION, KNOB MUTATION | 589 |
| hu11F11(ver.2)(M428L)-VH6-DMP bivalen | Hu11F11-VLv3 4c | hu11F11(ver.2)(M428L)-VH-DMP6 bivalent (HC) | 622 | hu11F11(ver.2 (IGG), M428L MUTATION, | 646 |
| | | | | (G4S)3, | 412 |
| | | | | VH6-DMP VL, | 368 |
| | | | | (G4S)4, | 411 |
| | | | | VH6-DMP VH | 249 |
| hu11F11(ver.2)(M428L)-VH6-DM bivalent | Hu11F11-VLv3 4c | hu11F11(ver.2)(M428L)-VH6-DM bivalent (HC) | 623 | hu11F11(ver.2 (IGG), M428L MUTATION, | 646 |
| | | | | (G4S)3, | 412 |
| | | | | VH6-DM bivalent VL, (G4S)4 | 367 |

TABLE 17-continued

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| | | | | (G4S)4, | 411 |
| | | | | VH6-DM VH | 248 |
| hu11F11(ver.2)(M428L)-VH7-DMP bivalent | Hu11F11-VLv3 4c | hu11F11(ver.2)(M428L)-VH7-DMP bivalent (HC) | 624 | hu11F11(ver.2 (IGG), M428L MUTATION, | 646 |
| | | | | (G4S)3, | 412 |
| | | | | VH7-DMP VL, | 373 |
| | | | | (G4S)4, | 411 |
| | | | | VH7-DMP VH | 254 |
| hu11F11(ver.2)(M428L)-VH7-DM bivalent | Hu11F11-VLv3 4c | hu11F11(ver.2)(M428L)-VH7-DM bivalent (HC) | 625 | hu11F11(ver.2 (IGG), M428L MUTATION, | 646 |
| | | | | (G4S)3, | 412 |
| | | | | VH7-DM VL, | 372 |
| | | | | (G4S)4, | 411 |
| | | | | VH7-DM VH | 253 |
| hu11F11(ver.2)(M428L)-VH9-DMP bivalent | Hu11F11-VLv3 4c | hu11F11(ver.2)(M428L)-VH9-DMP bivalent (HC) | 626 | hu11F11(ver.2 (IGG), M428L MUTATION, | 646 |
| | | | | (G4S)3, | 412 |
| | | | | VH9-DMP VL, | 378 |
| | | | | (G4S)4, | 411 |
| | | | | VH9-DMP VH | 259 |
| hu11F11(ver.2)(M428L)-VH9-DM bivalent | Hu11F11-VLv3 4c | hu11F11(ver.2)(M428L)-VH9-DM bivalent (HC) | 627 | hu11F11(ver.2 (IGG), M428L MUTATION, | 646 |
| | | | | (G4S)3, | 412 |
| | | | | VH9-DM VL, | 377 |
| | | | | (G4S)4, | 411 |
| | | | | VH9-DM VH | 258 |
| hu11F11(ver.2)(M428L)-VH9-DMP monovalent | Hu11F11-VLv3 4c | hu11F11(ver.2)(M428L)-VH9 -DMP monovalent, (HC 1, -hole) | 628 | hu11F11(ver.2 (IGG), M428L, HOLE MUTATION, | 647 |
| | | | | (G4S)3, | 412 |
| | | | | VH9-DMP VL, | 378 |
| | | | | (G4S)4, | 411 |
| | | | | VH9-DMP VH | 259 |
| | | hu11F11(ver.2)(M428L)-VH9 monovalent, deamidated, S->P (HC 2, -knob) | 589 | hu11F11(ver.2 (IGG),M428L MUTATION, KNOB MUTATION | 589 |
| hu11F11(ver.2)(M428L)-VH9-DM monovalent | Hu11F11-VLv3 4c | hu11F11(ver.2)(M428L)-VH9-DM monovalent (HC 1, -hole) | 629 | hu11F11(ver.2 (IGG), M428L, HOLE MUTATION, | 647 |
| | | | | (G4S)3, | 412 |
| | | | | VH9-DM VL, | 377 |
| | | | | (G4S)4, | 411 |
| | | | | VH9-DM VH | 258 |
| | | hu11F11(ver.2)(M428L)-VH9 monovalent, deamidated, S->P (HC 2, -knob) | 589 | hu11F11(ver.2 (IGG),M428L MUTATION, KNOB MUTATION | 589 |
| hu11F11(ver.2)(M428L)-VH16-DMP bivalent | Hu11F11-VLv3 4c | hu11F11(ver.2)(M428L)-VH16-DMP bivalent (HC) | 630 | hu11F11(ver.2 (IGG), M428L MUTATION, | 646 |
| | | | | (G4S)3, | 412 |
| | | | | VH16-DMP VL, | 383 |
| | | | | (G4S)4, | 411 |
| | | | | VH16-DMP VH | 264 |
| hu11F11(ver.2)(M428L)-VH16-DM bivalent | Hu11F11-VLv3 4c | hu11F11(ver.2)(M428L)-VH16-DM bivalent (HC) | 631 | hu11F11(ver.2 (IGG), M428L MUTATION, | 646 |
| | | | | (G4S)3, | 412 |
| | | | | VH16-DM VL, | 382 |
| | | | | (G4S)4, | 411 |
| | | | | VH16-DM VH | 263 |
| hu11F11(ver.2)(M428L)-VH16-DMP monovalent | Hu11F11-VLv3 4c | hu11F11(ver.2)(M428L)-VH16-DMP monovalent (HC 1, -hole) | 632 | hu11F11(ver.2 (IGG), M428L, HOLE MUTATION, | 647 |
| | | | | (G4S)3, | 412 |
| | | | | VH16-DMP VL, | 383 |
| | | | | (G4S)4, | 411 |
| | | | | VH16-DMP VH | 264 |
| | | hu11F11(ver.2)(M428L)-VH16 monovalent, deamidated, S->P (HC 2, -knob) | 589 | hu11F11(ver.2 (IGG),M428L MUTATION, KNOB MUTATION | 589 |

TABLE 17-continued

| Bispecific antibody Clone ID | Light chain of bispecific antibody | Combined heavy chain of bispecific antibody | SEQ ID | Explanation for Combined heavy chain of bispecific antibody | SEQ ID |
|---|---|---|---|---|---|
| hu11F11(ver.2)(M428L)-VH16-DM monovalent | Hu11F11-VLv3 4c | hu11F11(ver.2)(M428L)-VH16-DM monovalent (HC 1, -hole) | 633 | hu11F11(ver.2 (IGG), M428L, HOLE MUTATION, (G4S)3, VH16-DM VL, (G4S)4, VH16-DM VH | 647<br>412<br>382<br>411<br>263 |
| | | hu11F11(ver.2)(M428L)-VH16 monovalent, deamidated, S->P (HC 2, -knob) | 589 | hu11F11(ver.2 (IGG),M428L MUTATION, KNOB MUTATION | 589 |
| hu11F11(ver.2)(M428L)-VH27-DMP bivalent (HC) | Hu11F11-VLv3 4c | hu11F11(ver.2)(M428L)-VH27-DMP bivalent (HC) | 634 | hu11F11(ver.2 (IGG), M428L MUTATION, (G4S)3, VH27-DMP VL, (G4S)4, VH27-DMP VH | 646<br>412<br>388<br>411<br>269 |
| hu11F11(ver.2)(M428L)-VH27-DM bivalent (HC) | Hu11F11-VLv3 4c | hu11F11(ver.2)(M428L)-VH27-DM bivalent (HC) | 635 | hu11F11(ver.2 (IGG), M428L MUTATION, (G4S)3, VH27-DM VL, (G4S)4, VH27-DM VH | 646<br>412<br>387<br>411<br>268 |
| hu11F11(ver.2)(M428L)-VH32-DMP bivalent | Hu11F11-VLv3 4c | hu11F11(ver.2)(M428L)-VH32-DMP bivalent (HC) | 636 | hu11F11(ver.2 (IGG), M428L MUTATION, (G4S)3, VH32-DMP VL, (G4S)4, VH32-DMP VH | 646<br>412<br>393<br>411<br>274 |
| hu11F11(ver.2)(M428L)-VH32-DM bivalent | Hu11F11-VLv3 4c | hu11F11(ver.2)(M428L)-VH32-DM bivalent (HC) | 637 | hu11F11(ver.2 (IGG), M428L MUTATION, (G4S)3, VH32-DM VL, (G4S)4, VH32-DM VH | 646<br>412<br>392<br>411<br>273 |
| hu11F11(ver.2)(M428L)-VH35-DMP bivalent | Hu11F11-VLv3 4c | hu11F11(ver.2)(M428L)-VH35-DMP bivalent (HC) | 638 | hu11F11(ver.2 (IGG), M428L MUTATION, (G4S)3, VH35-DMP VL, (G4S)4, VH35-DMP VH | 646<br>412<br>398<br>411<br>279 |
| hu11F11(ver.2)(M428L)-VH35-DM bivalent | Hu11F11-VLv3 4c | hu11F11(ver.2)(M428L)-VH35-DM bivalent (HC) | 639 | hu11F11(ver.2 (IGG), M428L MUTATION, (G4S)3, VH35-DM VL, (G4S)4, VH35-DM VH | 646<br>412<br>397<br>411<br>278 |

Effect of the Invention

The antibody prepared in one embodiment of the present invention specifically binds IGF1R with optimized binding force suitable for brain endothelial transcytosis, and can be useful for the delivery of therapeutic antibodies for brain degenerative disease and brain cancer that have limited therapeutic efficacy due to low capacity of vascular brain barrier penetration. In particular, the monoclonal antibody disclosed in the present invention does not affect binding of the ligands such as IGF-1, IGF-2 and insulin or its homolog to IGF1R, and exhibits effects without inhibiting signaling through the IGF1R. Therefore, it has usefulness related with the penetration of blood brain barriers.

The antibodies disclosed herein can effectively remove or promote degradation of alpha-synuclein aggregates, and inhibit intercellular delivery of alpha-synuclein, and thus can be usefully used in the treatment of diseases associated with accumulation of alpha-synuclein aggregates.

BRIEF DESCRIPTION OF THE DRAWINGS

FIG. 3B is a table showing the results of FIG. 3A.

FIG. 4B is a table showing the results of FIG. 4A.

FIG. 18A is the result identifying the residue of deamidation in the anti-IGF1R antibody prepared in an embodiment of the present invention.

FIG. 18B shows the variants prepared by substituting specific amino acid to prevent deamidation. LLIYANSN: SEQ ID NO: 651. GAWDDSLNG: SEQ ID NO: 652. AISYDNGNT: SEQ ID NO: 653.

MODE FOR INVENTION

Figures 1, 2:
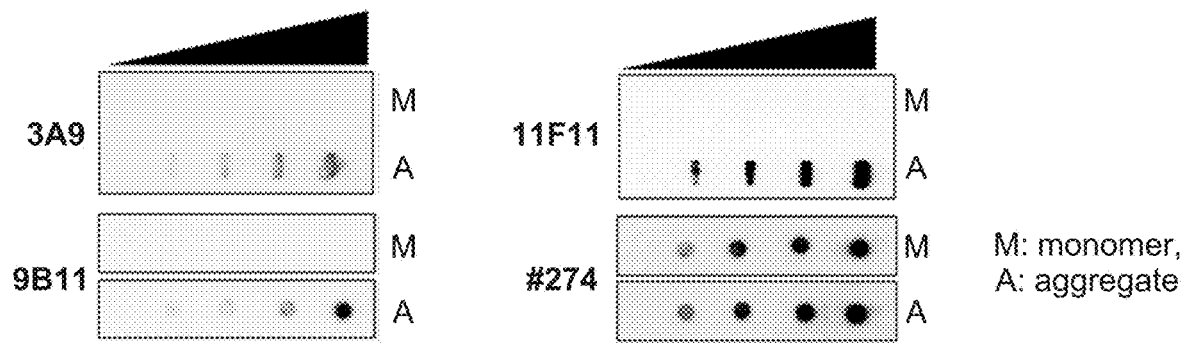
FIG. 1 is a dot-blot result showing that the anti-alpha-synuclein antibody prepared in an embodiment of the present invention specifically binds to the native alpha-synuclein in the aggregated form.
FIG. 2 is a result of ELISA analysis for the affinity of the anti-alpha-synuclein antibody prepared in an embodiment of the present invention.

Example 1: Preparation of Mouse Alpha-Synuclein Antibody 1-1: Immunization and Hybridoma Production Alpha-synuclein monomers with a full length (140 residues) or cleaved with C-terminal 21 residues (119 residues) were placed in a thermomixer at 37° C., aggregated with shaking at 1050 rpm for 14 days, and sonicated. Each of 140 residues and 119 residues of the α-syn fibril at 1 mg/mL was mixed with the adjuvant at a ratio of 1:1 (vol:vol).

Amino acid sequence of *Homo sapiens* alpha-synuclein (SEQ ID NO: 559):

MDVFMKGLSKAKEGVVAAAEKTKQG-
VAEAAGKTKEGVLYVGSKTKEGVVHG VAT-
VAEKTKEQVTNVGGAVVTGVTAVAQKTVEGAG-
SIAAATGFVKKDQLGKNEEGAP
QEGILEDMPVDPDNEAYEMPSEEGYQDYEPEA

Then, 200 µL of the prepared mixture was injected subcutaneously into 5 to 7 weeks old BALB/c female mice. After 2 weeks, 200 µL of the prepared mixture was further injected subcutaneously for antibody boosting. After one week of boosting, blood was collected and immunization titration was performed by the ELISA method using the administered antigen. Subsequently, third boosting was performed by subcutaneous injection of antigen alone.

The spleen of the immunized mouse was removed, and the spleen cells were obtained from the spleen. The spleen cells were suspended in Hybridoma-SFM medium (Thermo Fisher Scientific, USA) supplemented with 10% FBS. To prepare the hybridoma, the spleen cells and SP2/0-Ag14 of a murine myeloma cell were mixed in a Hybridoma-SFM medium without serum, and followed by centrifugation to remove the medium. Then, PEG was added to the obtained cell pellet and incubated at 37° C. for 1 minute to induce cell fusion.

1-2: Single Cell Cloning and Purification of Antibodies

After 2 weeks in the fusion, the fusion with mouse B cells producing antibodies was confirmed with an ELISA method using the antigen administered to the mouse and a cell culture medium. Then, single-cell cloning was carried out using a hybridoma to select 16 hybridomas producing monoclonal antibodies. 9B11 clones (IgG1 kappa) were obtained using the aggregate of full length (140 residues) α-syn as an antigen, and Clones of 3A9 and 11F11 (IgG2b kappa, and IgG2b kappa, respectively) were obtained using α-syn aggregates with cleaved C-terminal 21 residues as antigens.

In order to purify the antibody, each hybridoma was cultured in RPMI1640 medium containing 10% FBS. For antibody production, the culture medium was replaced with serum-free SFM medium and cultured for about 4 days. The cell culture supernatant was separated, centrifuged, filtered with a 0.22 m filter, and purified with a protein G column for IgG1 type and a protein A column for the remaining antibodies.

1-3: Determination of Variable Region Sequence

The variable region and CDR sequences were determined by referring to the disclosure Ahn et al., Mol. Cells 2004, 18 (2): 237-241. Hybridomas were cultured and centrifuged to isolate only the cells. The RNA was isolated from the isolated hybridoma by the addition of a triazole and was used for synthesizing cDNA as a template. The variable region and CDR sequence were confirmed by sequencing.

Example 2. Preparation of Anti-Alpha-Synuclein (Chimeric) Antibodies 2-1: Antibody Cloning and Expression By using the nucleotide sequences of the heavy chain variable region and the light chain variable region antibody obtained after humanization, gblock (m.biotech) of a short nucleotide fragment was synthesized, and cloned into the animal cell culture vector (pcDNA3.4). The gblock was synthesized by including about 20 bp overlapped sequence before and after the variable region, and the part of the pcDNA3.4 vector excluding the variable region was amplified by PCR and cloned by Gibson assembly method.

In order to transfect and express the cloned antibody, the prepared vector was used for maxi-prep (Qiagen) to obtain a large amount of plasmid DNA, and then introduced into cells as follows. The day before transfection, the concentration of ExpiCHO™ (Gibco, Cat: A29127) cells was adjusted to concentration of 3×10E6 to 4×10E6 viable cells/mL in in ExpiCHO™ expression medium (Gibco, Cat: A29100-01) and cultured at 8% $CO_2$, at 37° C. and 120 rpm for 1 day. On the day of DNA transfection, the cells that were grown to 7×10E6 to 10×10E6 viable cells/mL and had survival rates of 95% or more were prepared by diluting using fresh medium. to $6×10^6$ viable cells/mL.

In order to transfect the parent cells, ExpiFectamine™ CHO & plasmid DNA complex was prepared by using the ExpiFectamine™ CHO transfection kit (Gibco, Cat: A29129). DNA and ExpiFectamine™ CHO reagents were prepared at appropriate concentrations by dispensing with cold OptiPRO™ SFM® (Gibco, Cat: 12309019) medium, were respectively inoculated, and mixed to stand at room temperature for 5 minutes. The product was inoculated into parent cells, and cultured after transfection. The day after transfection, the enhancer and feed included in the Expi-Fectamine™ CHO transfection kit were inoculated into transfected cells, and after 5 days, the feed was additionally inoculated, followed by incubation for 10 days at 8% $CO_2$, 37° C., and 120 rpm to produce the transfected cells.

In order to obtain the culture solution, the culture medium was transferred to a centrifuge bottle for centrifugation and centrifuged at 4° C. and 6500 rpm for 30 minutes, followed by filtering with a filter having a size of 0.2 m to obtain a culture medium with removing suspended solids, and then the culture medium was used for subsequent purification.

2-2: Purification and Sequencing of Antibody

The culture was purified using HiTrap MabSelectSure (GE Healthcare, 11-0034-94). After equilibrating with an equilibration buffer (50 mM Tris-HCl pH 7.2, 100 mM NaCl), the recovered culture was loaded onto a column. When the loading was completed, the medium was washed with 50 mM Sodium Citrate (pH 5.0), and then eluted using 50 mM Sodium Citrate (pH 3.4). 1M Tris-HCl pH 9.0 was added to the eluate to neutralize to pH 6.0. Then, the eluate was buffer exchanged and concentrated with PBS (phosphate buffered saline, pH 7.4) and stored at 4° C. until subsequent use.

When additional purification was required, a second purification was performed based on the size of the eluted sample by passing the first purified product through 1×PBS buffer on the HiLoad 26/600 Superdex 200 column. The amino acid sequence of the purified antibody was analyzed by mass spectrometry, and confirmed to be consistent with the variable region of the mouse-derived monoclonal antibody.

The backbone variable region portion of the human IgG1 isotype was replaced with the variable regions of the 3A9, 9B11, and 11F11 antibodies identified by the above method to prepare a chimeric human IgG1 antibody. Among the obtained chimeric antibodies, especially Ch11F11 antibody is an antibody in the form of IgG and comprises a combination of the heavy chain variable region sequence of SEQ ID NO: 523 (ch11F11-VH) and the light chain variable region sequence of SEQ ID NO: 542 (ch11F11-VL), and Ch 3A9 antibody is an antibody in the form of IgG and comprises a combination of heavy chain variable region sequence of SEQ ID NO: 535 (ch3A9-VH) and light chain variable region sequence of SEQ ID NO: 549 (ch3A9-VL).

Example 3: Production of Humanized Antibody 3-1: Library Phage Preparation

A mini-library in which a mouse or human-derived sequence was introduced into each CDR residue was constructed, while binding the human framework to the CDR1, CDR2, and CDR3 residues of the chimeric antibody.

The competent cells of the produced min library were inoculated in 2×YT medium [17 g of Tripton (CONDA, 1612.00), 10 g of yeast extract (CONDA, 1702.00) and 5 g of NaCl (Sigma, S7653)] containing 34 μg/mL of chloramphenicol (Sigma, C0857), 2% glucose (Sigma, G5400) and 5 mM MgCl2 (Sigma, C0857) at 30° C. for 3 hours to be OD600 of 0.5 to 0.7. Then, the cells were infected with a helper phage, and cultured in 2×YT medium containing 34 μg/mL of chloramphenicol, 5 mM MgCl2, 70 μg/mL of kanamycin (Sigma, K1876) and 1 mM IPTG (ELPISBIO, IPTG025) at 30° C. for 6 hours to induce the phage packing. The culture solution was centrifuged at 4500 rpm at 4° C. for 15 minutes. The supernatant was added with 4% PEG 6000 (Fluka, 81253) and 3% NaCl (Sigma, S7653) and incubated for 1 hour on ice. The product was centrifuged at 8000 rpm for 20 minutes at 4° C., and then, the pellet was suspended in PBS and centrifuged again at 4° C. and 12,000 rpm for 10 minutes to obtain a supernatant containing the phage library. The obtained supernatant was stored at 4° C. until subsequent use.

3-2: Phage Display Panning

In order to select antibodies that preferentially bind to alpha-synuclein aggregates over the monomers, the panning was performed using the full-length alpha-synuclein aggregates prepared in Example 1, and total three panning were performed as follows.

Bovine serum albumin (BSA) was added to the cells at a concentration of 3% in a test tube at 4° C. overnight, adding 10 μg/mL of recombinant alpha-synuclein aggregates and monomers to the PBS in an immunotube (MaxiSorp 444202) solution was added to the test tube and the surface of which alpha-synuclein aggregates and monomers were not adsorbed was protected. After emptying the test tube, the antibody phage library of 10¹² CFU dispersed in BSA 3% solution was put into the immunotube in which the alpha-synuclein aggregates and monomers were absorbed and reacted for 1 hour (negative selection). Then, the phages not bound to alpha-synuclein aggregates and monomers were recovered and reacted for 2 hours at room temperature in the alpha-synuclein aggregates and monomers were adsorbed. Phosphate buffered saline (0.05% Tween 20) solution was used to recover 100 μM triethylamine solution, which was recovered by using a PBS-T solution. E. coli at 37° C. for 1 hour, and the infected E. coli was painted out on a 2×YT agar medium and cultured at 37° C. overnight (pH 7.4), they were infected by ER2537. Next day, the cultured E. coli was suspended in a 4 ml of 2×YT culture solution containing carbenicillin and 15% glycerol was added, and a part was stored at −80° C. and the rest was used for preparing phages for next experiments. By repeating this process at 3 rounds in total, alpha-synuclein antigen-specific phage pool was amplified and concentrated. As the panning round progressed, the number of washing using PBS-T was increased to amplify and concentrate the antigen-specific phage.

3-3: Single Clone Screening

To sort monoclonal antibodies specifically binding to alpha-synuclein aggregates from the phage pool obtained through the panning, the experiment as follows was performed.

To isolate monoclones from the concentrated pool, after painting out the phage pool on a LB-tetracycline/carbenicillin agar medium and culturing, a single colony was secured. Then, after inoculating monoclones on a 96-deep well plate in which 400 μL of 2×YT-tetracycline/carbenicillin medium was put per well and growing overnight, 10 μL culture solution was put on a new 96-deep well plate in which 390 μL of 2×YT-tetracycline/carbenicillin medium was put and it was cultured at 37° C. for 4 hours. 1 mM IPTG was put into the culture solution and it was cultured at 30° C. overnight. The culture solution cultured overnight was centrifuged to take a supernatant.

Then, the clones expressing a monoclone-soluble scFv which binds to alpha-synuclein aggregate were selected by using the ELISA method as follows (Steinberger. Rader and Barbas III. 2000. Phage display vectors. In: Phage Display Laboratory Manual. 1sted. Cold Spring Harbor Laboratory Press. NY. USA. pp.11.9-11.12). specifically, the selected 7B7 antibody in Example 1-1 was put on a 96-well plate (Nunc-Immuno Plates, NUNC, USA) and it was coated at 4° C. overnight. 3% BSA was added to each well in an amount of 200 μL, followed by blocking at 37° C. for 2 hours. Then, the alpha-synuclein aggregates and the monomer were loaded at a concentration of 100 ng/well, reacted at 37° C. for 2 hours and washed five times with 300 μL of PBS-T. The prepared single clone supernatant was mixed with 3% BSA in a volume ratio of 1: 1 (vol: vol), and 100 μL of the solution was loaded on the plate bound to the aggregate and the monomer, followed by reaction at 37° C. for 2 hours. The cells were washed five times with 300 L of PBS-T, and incubated at 37° C. for 1 hour with an anti-HA HRP-conjugated antibody, followed by washing with PBS-T five times. After adding 100 μL of TMB (tetramethylbenzidine, Sigma, T0440), the reaction was stopped by adding 50 μL of 1 N H 2 SO 4 to measure the absorbance at 450 nm. Clones with an absorbance of 0.5 or greater were regarded as positive reaction by binding and clones bind to BSA non-specifically were excluded.

The CDR residues of clones found in the library are analyzed in silico in parallel and the clones to cause serious problems with binding to the framework or clones that do not have T-cell epitope, B cell epitope, and MHCII epitope in the framework parts other than CDR were selected.

Subsequently, for five antibodies prepared by the following combination of heavy chain and light chain variable regions, the humanized antibody variable region of the human IgG1 isotype was replaced with the backbone variable region portion to prepare five IgG1 backbone humanized antibodies. Specifically, Hu11F11 (ABL2-4) is an antibody of IgG type, and includes a combination of heavy chain variable region sequence of SEQ ID NO: 525 (Hu11F11-VH2) and light chain variable region sequence of SEQ ID NO: 546 (Hu11F11-VL4). Hu11F11 (ver.1) is an antibody of IgG type, and includes a combination of heavy chain variable region sequence of SEQ ID NO: 531 (Hu11F11-VH-v1) and light chain variable region sequence of SEQ ID NO: 548 (Hu11F11)-VLv3 4c). Hu11F11 (ver.2) is an antibody of IgG type and includes a combination of heavy chain variable region sequence of SEQ ID NO: 532 (Hu11F11-VH-v2) and light chain variable of SEQ ID NO: 548 (Hu11F11-VLv3 4c). Hu11F11 (ver.3) is an IgG type antibody, and includes heavy chain variable region sequence of SEQ ID NO: 533 (Hu11F11-VH-v3) and light chain variable region sequence of SEQ ID NO: 548 (Hu11F11-VLv3 4c). Hu11F11 (ver.4) is a combination of heavy chain variable region sequence of SEQ ID NO: 534 (Hu11F11-VH-v4) and light chain variable region sequence of SEQ ID NO: 548 (Hu11F11-VLv3 4c).

Example 4. Analysis of Antigen Binding Specificity and Binding Affinity by Using Alpha-Synuclein Antibody 4-1: Dot Blot Analysis Using Anti-Alpha-Synuclein Antibody Dot blot experiments were performed to analyze whether the antibody of the present invention bound to monomers or aggregates in the native state. For the experiment, 50 ng or 100 ng of α-syn monomer or fibrin protein (manufactured by Professor Lee Seung-jae of Seoul National University; Bae et al., J. Neurosci 32: 13454, 2012) were spot-loaded on the nitrocellulose membrane. Twice-fold diluted monomer or fibril proteins were loaded sequentially from the right side of the membrane to the left (12.5, 25, 50, 100 ng). The membrane was blocked with 5% non-fat dry milk of TBST composition for 1 hour at room temperature. 1 mg/ml of the α-syn antibody prepared in Example 1 was added to TBST containing 1% bovine serum albumin and were incubated at room temperature for 1 hour. After washing with TBST, signals were analyzed using a chemiluminescence substrate (NEN) as substrate and secondary antibody conjugated with HRP (horse radish peroxidase) according to the manufacturer's manual. The results were imaged using a LAS-3000 Luminescent Image Analysis System (FUJIFILM Life Science). The results are shown in FIG. 1.

As shown in FIG. 1, the alpha-synuclein antibody of the present invention was found to preferentially bind to aggregates as compared to alpha-synuclein monomers. Particularly, 9B11, 3A9 and 11F11 bound only to the aggregate. 274 antibody (Bae et al., J Neurosci. 2012 Sep. 26; 32(39): 13454-13469) was used as a comparative antibody that binds to both monomers and aggregates.

4-2: ELISA Analysis Using Mouse Monoclonal Anti α-Syn Antibody

ELISA analysis was performed to quantitatively analyze the binding affinity of the antibody of the present invention to the antigen. For this, alpha-synuclein antibody obtained in Example 1 was coated on a 96-well plate at a concentration of 1 µg/mL and treated with alpha-synuclein fibril aggregates at 10, 100, 1000 and 10,000 ng/ml. After washing with PBS, streptavidin conjugated with HRP and secondary antibody conjugate with biotin was treated and then reacted with TMB as a substrate. The absorbance was measured and the results are shown in FIG. 2.

As shown in FIG. 2, the antibodies of the present invention were found to preferentially bind to aggregates with a high binding affinity. The ELISA results showed that the antibodies binding preferentially to aggregates have the affinity of $0.1 \times 10^{-9}$ M to $2 \times 10^{-9}$ M, while the antibodies binding to both monomers and aggregates showed higher affinity of $\sim 1 \times 10^{-10}$ M than these antibodies. The antibody of the present invention preferentially bound to alpha-synuclein aggregates with a high affinity, but the affinity for the monomer could not be obtained, because it bound to monomer with a lower affinity than aggregate or did not bind to monomer. These results indicate that the antibody can remove effectively or inhibit the acting of the agent causing neurodegenerative diseases associated with alpha-synuclein etiology such as Parkinson's disease.

4-3. BIAcore Analysis Using Anti-Alpha-Synuclein Antibody

The quantitative analysis of the binding of alpha-synuclein antibody prepared in Example 1 to monomer and aggregate antigens was performed using BIAcore analysis.

The used instrument was T200 (GE Healthcare, S/N: 1565888). Protein A is used as a chip (GE Healthcare, Cat. 29-1275-56). 10 mM Glycine-HCl pH 1.5 (GE Healthcare, Cat. BR-1003-54) was regeneration buffer. The running buffer, analyte dilution, and the sample dilution buffer were HBS-EP. The α-syn antibodies (3A9, 9B111 and 11F11) prepared in Example 1 were diluted with 1×HBS-EP (GE Healthcare, Cat. BR-1006-69), and alpha-synuclein monomer (1 mg/mL) and fibril protein (3 mg/mL) were serially diluted in duplicate and analyzed at 6 concentrations (0, 0.39, 1.56, 6.25, 25, 100 nM) including 0 nM in total. For the capture, the monomer was for RU of 800 (theoretical), and a fibril was for RU of 100 (theoretical). The capture phase was performed at contact time of 60 seconds, a flow rate of 30 µL/min, and a stabilization period of 180 seconds. The association phase was performed at the association time of 120 seconds and the flow rate was 30 µL/min. The dissociation phase was performed at the dissociation time of 360 seconds and the flow rate of 30 µL/min. The regeneration phase was performed twice time at the regeneration time of 240 seconds (primary) and 60 seconds (secondary) and a flow rate of 30 µL/min. The fitting was carried out using 1:1 binding model, and the evaluation software was BIACore T200 Evaluation software (GE healthcare). The results are shown in FIGS. 3A and 3B.

Figure 3A:
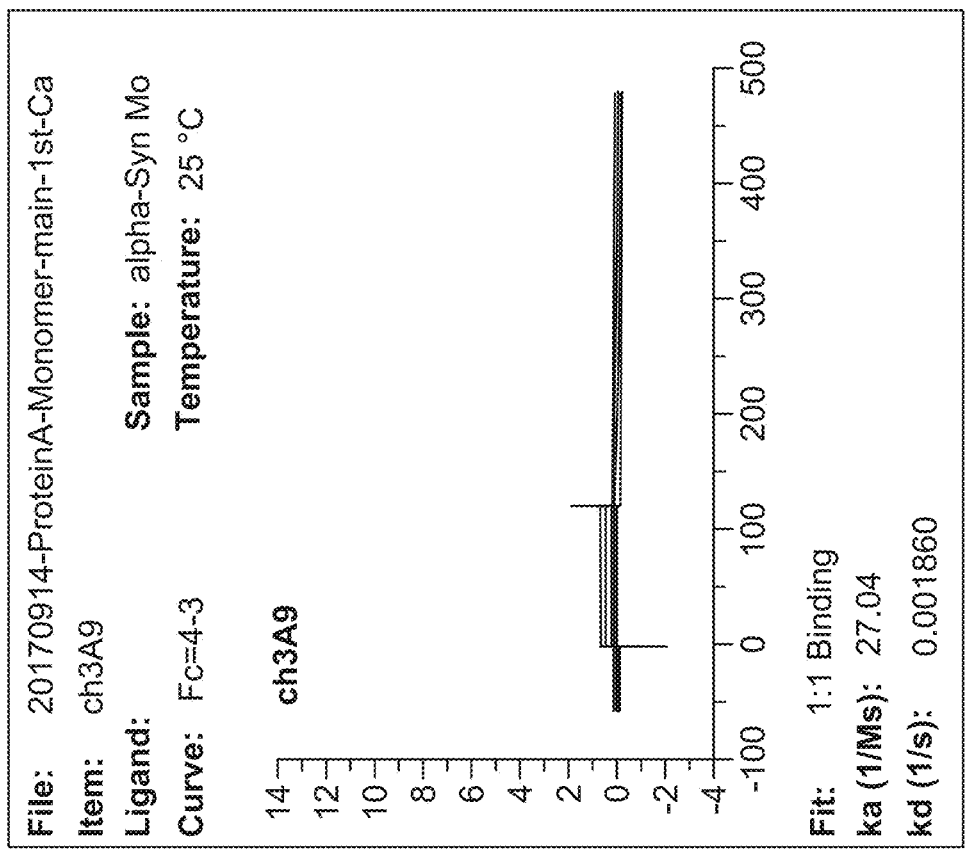
FIG. 3A is a result of BIAcore analysis for the specificity and affinity of the preferential binding of the anti-alpha-synuclein antibody prepared in an embodiment of the present invention to alpha-synuclein aggregate.
Figure 3A:
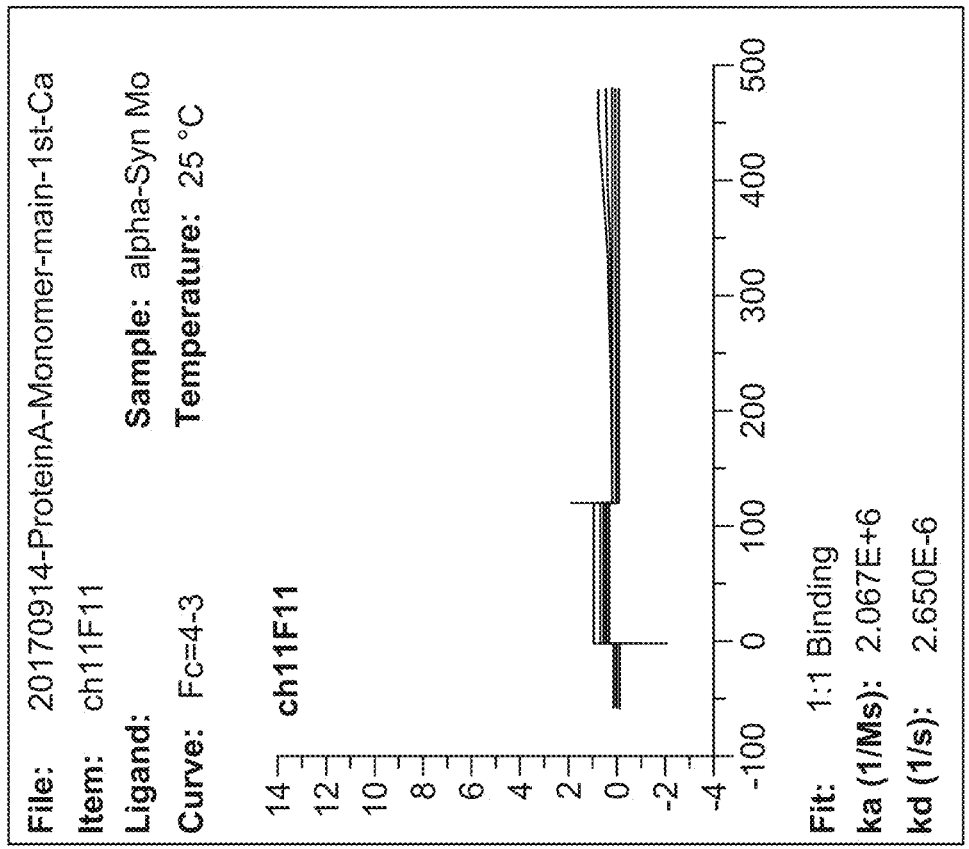
Figure 3A:
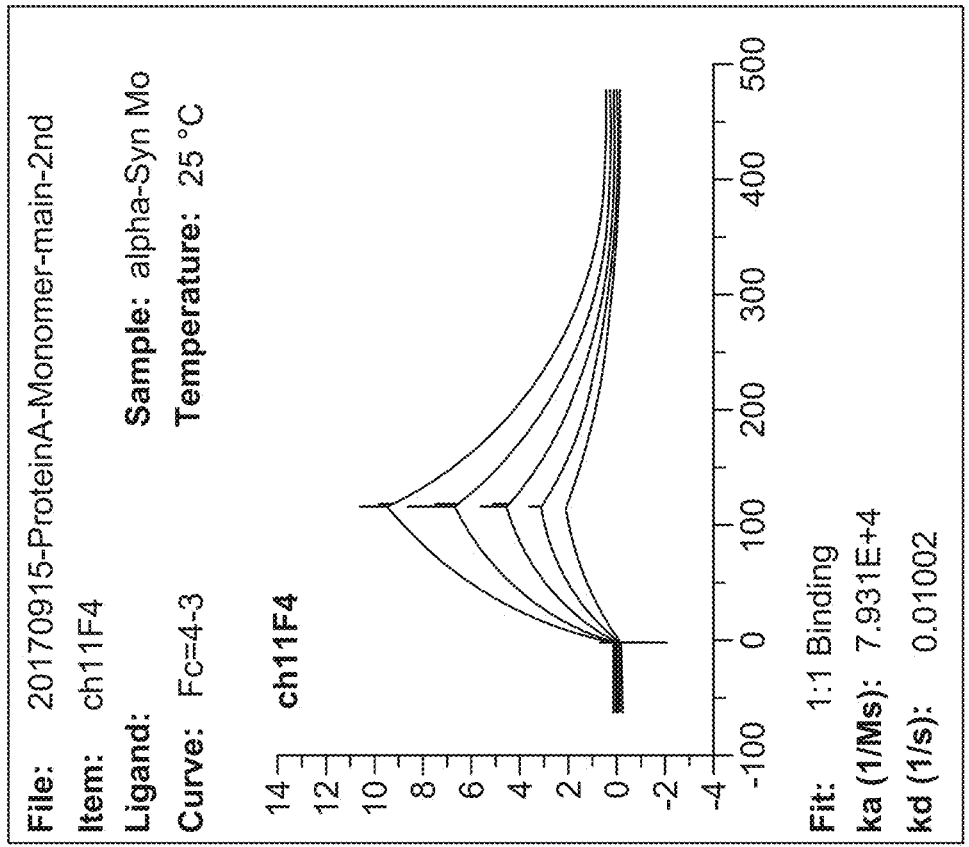
Figure 3A:
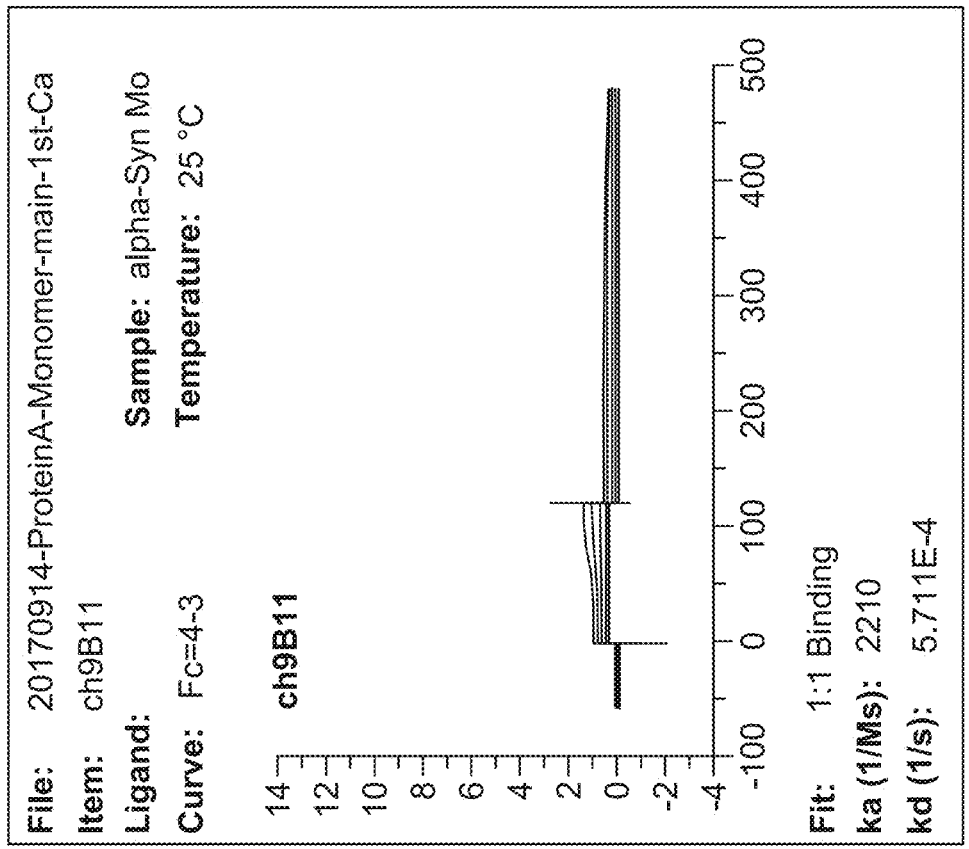
Figure 3A:
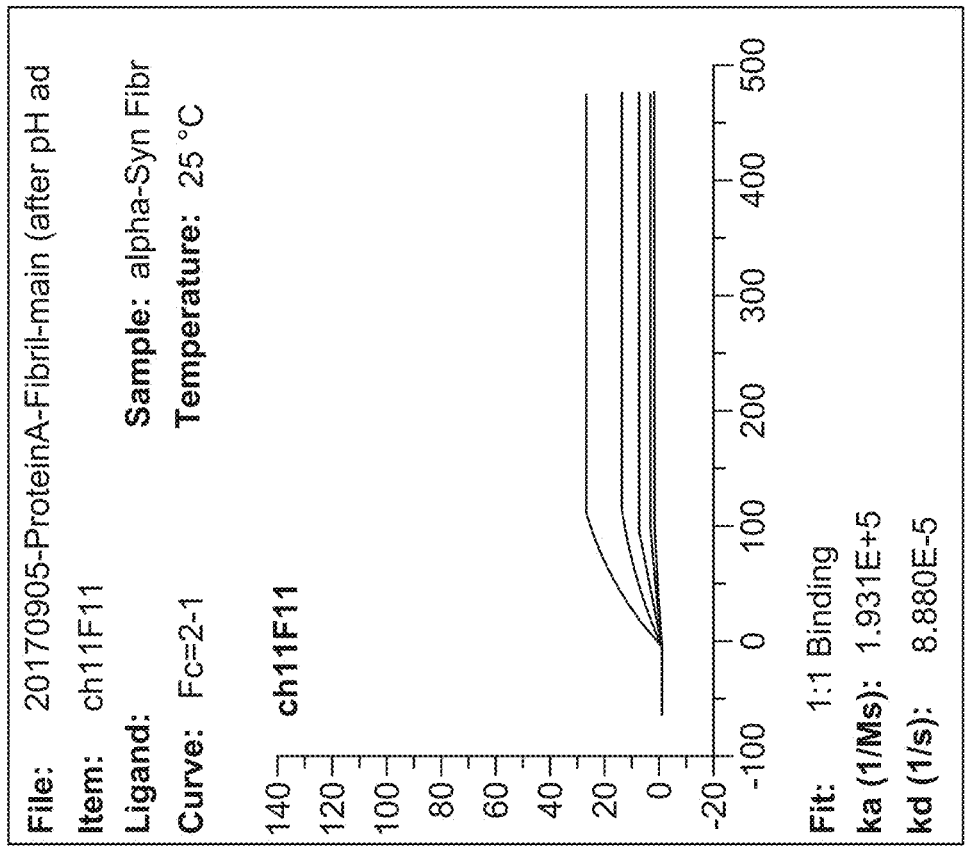
Figure 3A:
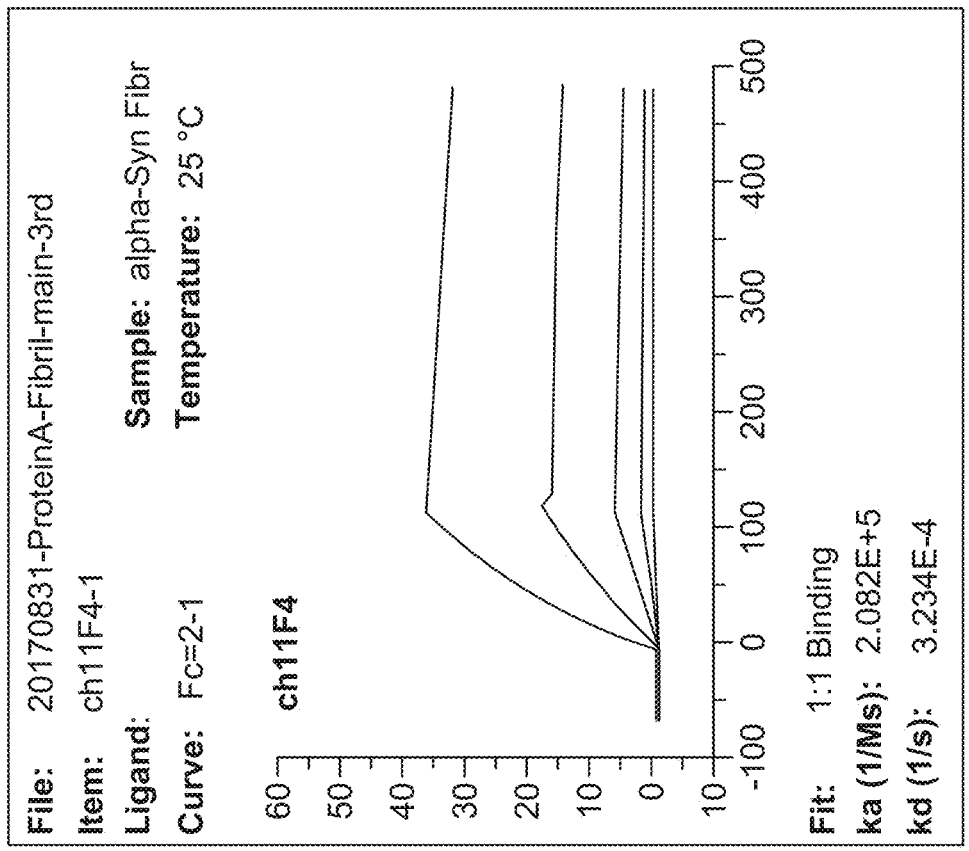
Figure 3A:
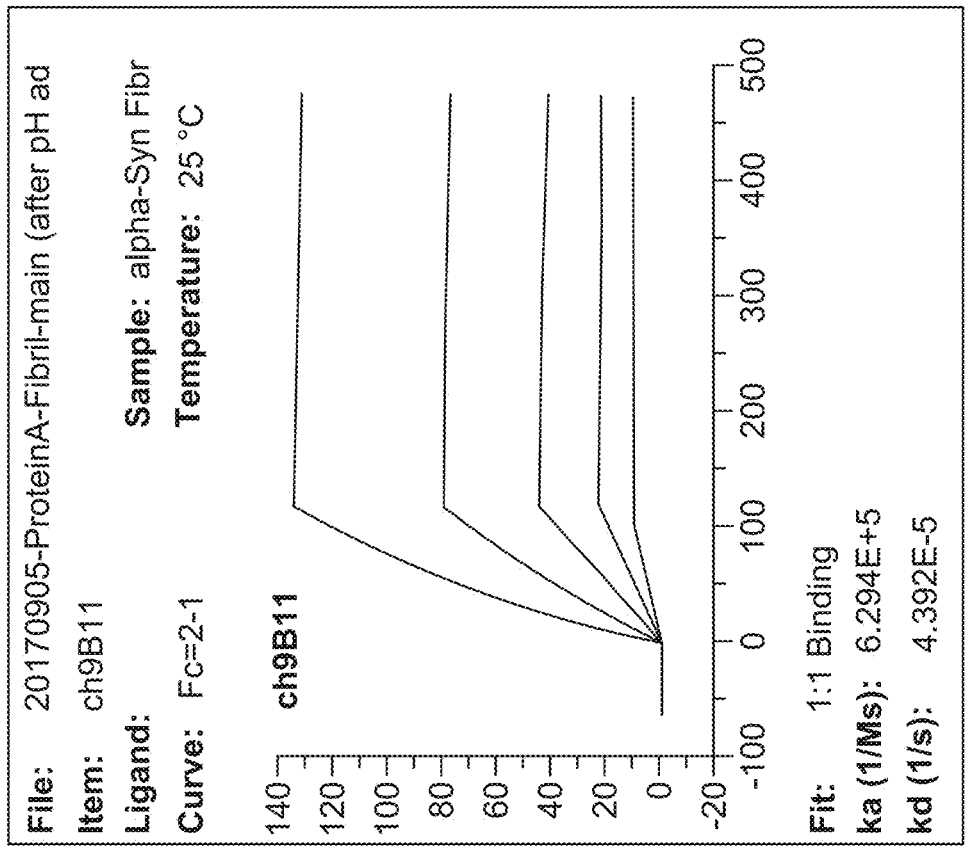

FIG. 3A is a result of BIAcore analysis of the preferential binding specificity and affinity of the monoclonal antibody prepared in an example of the present invention to the alpha-synuclein aggregates. It shows that the antibody of the present invention binds to the aggregate with a high affinity. These results indicate that the antibody can remove effectively or inhibit the acting of the agent causing neurodegenerative diseases associated with alpha-synuclein etiology such as Parkinson's disease. FIG. 3B is a table showing the results of FIG. 3A.

As shown in FIGS. 3A and 3B, 3A9, 9B11 and 11F11 of which the preferential binding to aggregates was confirmed among analyzed four alpha-synuclein antibodies by the other methods described above, bound only to aggregates as a high affinity of about $1 \times 10^{-9}$ M to $3 \times 10^{-9}$ M in BIAcore analysis.

4-4. Octet Analysis Using Mouse Monoclonal Anti α-Syn Antibody

The quantitative analysis of the binding of the alpha-synuclein antibodies (3A9, 9B11, 11F11) prepared in Example 1 to monomer and aggregate antigens was performed using Octet.

Figure 4A:
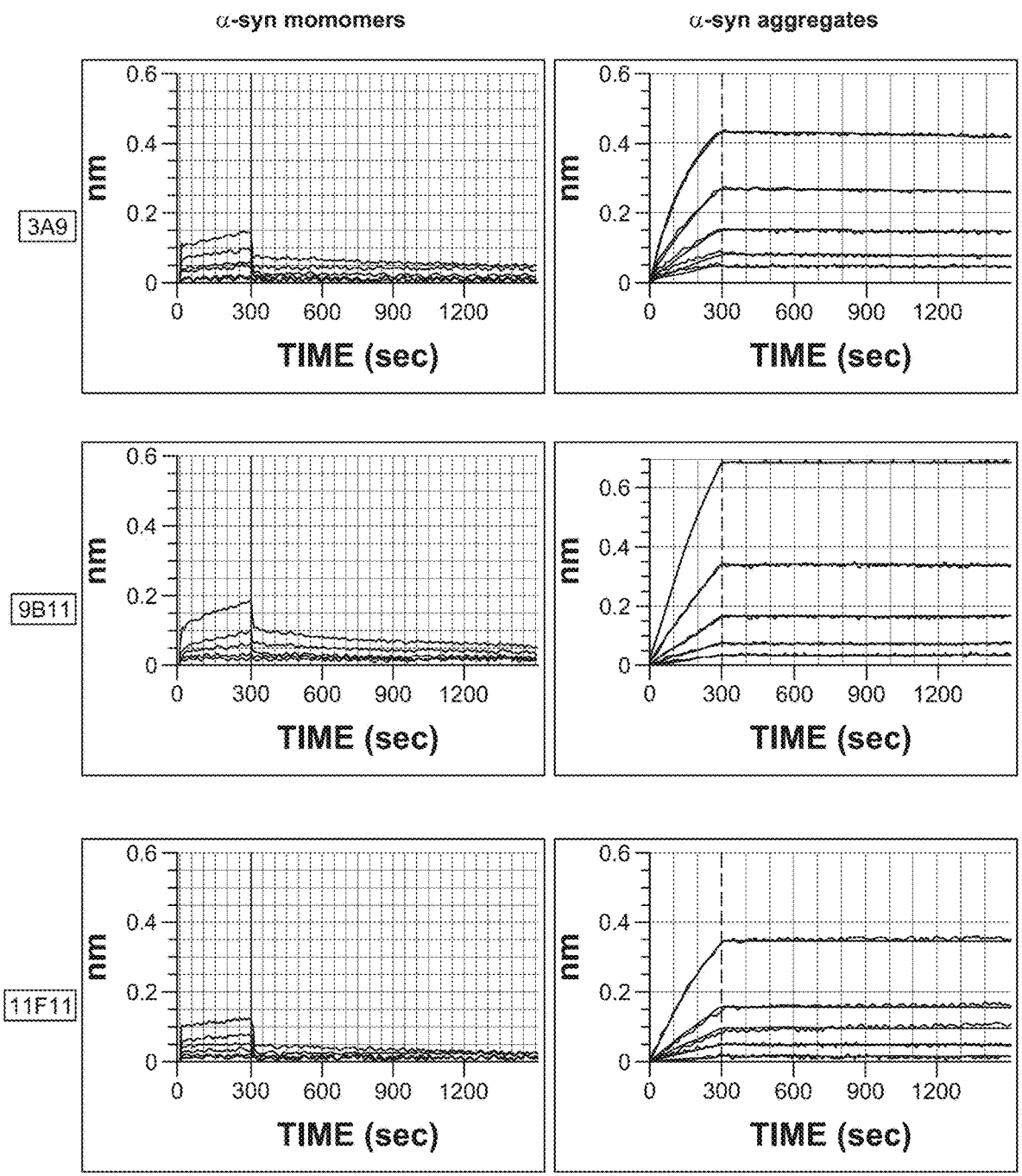
FIG. 4A is a result of Octet analysis for the preferential binding specificity of the anti-alpha-synuclein antibody prepared in an embodiment of the present invention binds preferentially to the alpha-synuclein aggregate.

Specifically, the running buffer was 1×KB buffer (cat. 18-1092) or 1×PBS buffer at 1000 rpm, and the immobilization buffer was sodium acetate, pH 5 (10 mM, Cat 18-1068. α-syn monomers was immobilized the α-syn antigen, and fibrils was immobilized the test antibody. The target concentrations were 20 µg/mL for the monomer and 0.4 µg/mL for the fibril. The kinetics concentration was diluted sequentially two times from 50 nM for monomers and from 100 nM for fibrils, to give 7 points in total, respectively. Association/dissociation time was 5 min/20 min for monomer and 5 min/25 min for fibril. Biosensor was ARG2 and fitting was performed using 1:1 fitting model. The results are shown in FIGS. 4A and 4B. FIG. 4A is Octet analysis result for the preferential binding specificity of the alpha-synuclein antibody of an embodiment of the present invention binds preferentially to the α-syn aggregate.

As shown in FIG. 4A, 3A9, 9B11 and 11F11 had been shown to hardly bind to monomers (red dotted box), but bind well to the aggregates (ascending line graph in red dotted box). These results are similar to or consistent with the results in Dot blot, Octet and ELISA analyses, and show that 3A9, 9B11 and 11F11 of which the preferential binding to aggregates are confirmed among analyzed four alpha-synuclein antibodies by the other methods described above, bind only to aggregates in Octet analysis. FIG. 4B is a table showing the results of FIG. 4A. The results of FIGS. 4A and 4B show the preferential binding to alpha-synuclein aggregates, and are consistent with the results of FIG. 1. The #274 antibody used as a control group was found to bind well to both monomers and aggregates.

Example 5. Detection of Lewy Body in Human Brain Tissue by Anti-Alpha-Synuclein Antibody The Lewy body and Lewy neurite in the paraffin-embedded brain sections in a thickness of ten micrometers obtained from patients who had died of Parkinson's disease (Dr. Halliday, University of Sydney) were stained by using the antibody used in Example 5 as follows. The tissue sections were treated with 90% formic acid for 3 minutes to process the antigen retrieval, and then peroxidase activity of the tissue itself was inhibited by 1% $H_2O_2$ (50% ethanol base). 10% normal horse serum was treated to prevent non-specific binding of the tissues. Subsequently, after washing with phosphate buffer, the adjacent sections were treated with 3A9, 11F11 and 11F11 antibodies of the present invention at 4° C. overnight. After washing with phosphate buffer, biotin-conjugated anti-human IgG antibody was treated at 37° C. for 30 minutes, and the avidin-biotin complex was reacted at room temperature for 30 minutes (Vectastatin Elite kit; Vector Laboratories).

Figure 5A:
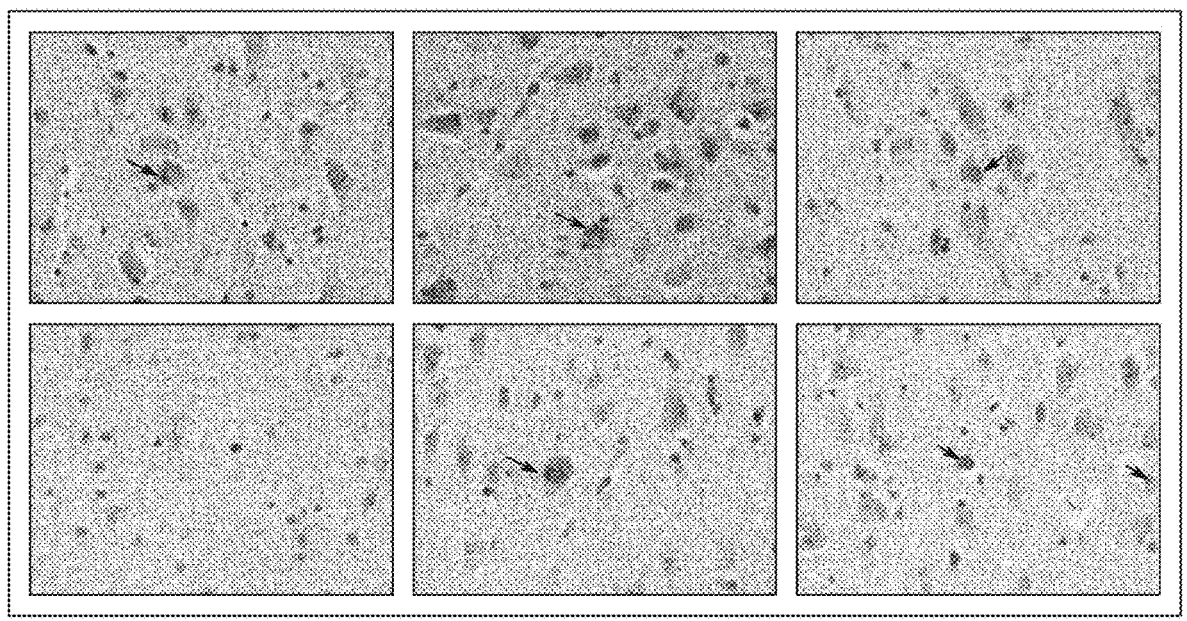
FIGS. 5A and 5B show the result of measuring that the anti-alpha-synuclein antibodies of 3A9 and 11F11 in an embodiment of the present invention can specifically recognize Lewy bodies and Lewy neurites in human brain tissue, respectively. It shows that the antibodies of the present invention bind to the Lewy bodies (arrow) and the Lewy neurites (thread-like shape in lower left part).
Figure 5B:
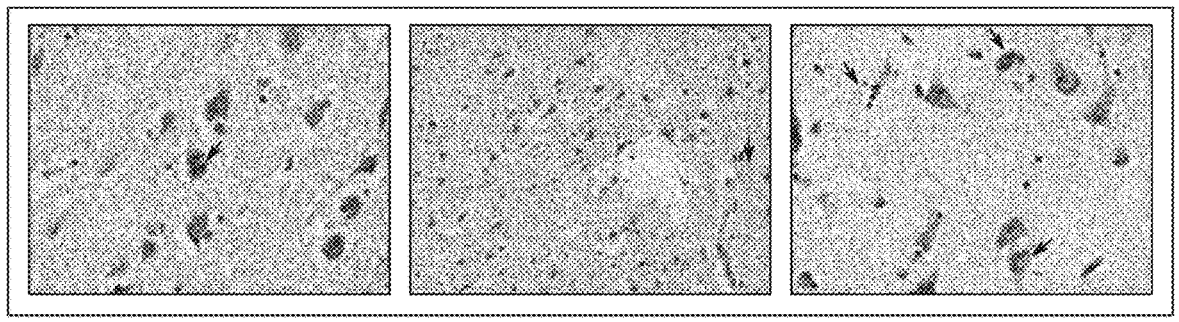

Then, the color was developed with DAB containing 0.005% $H_2O_2$, and the sections were counter-stained with 0.5% cresyl violet, to discriminate each cell. The results are shown in FIGS. 5A and 5B.

Figure 8A:
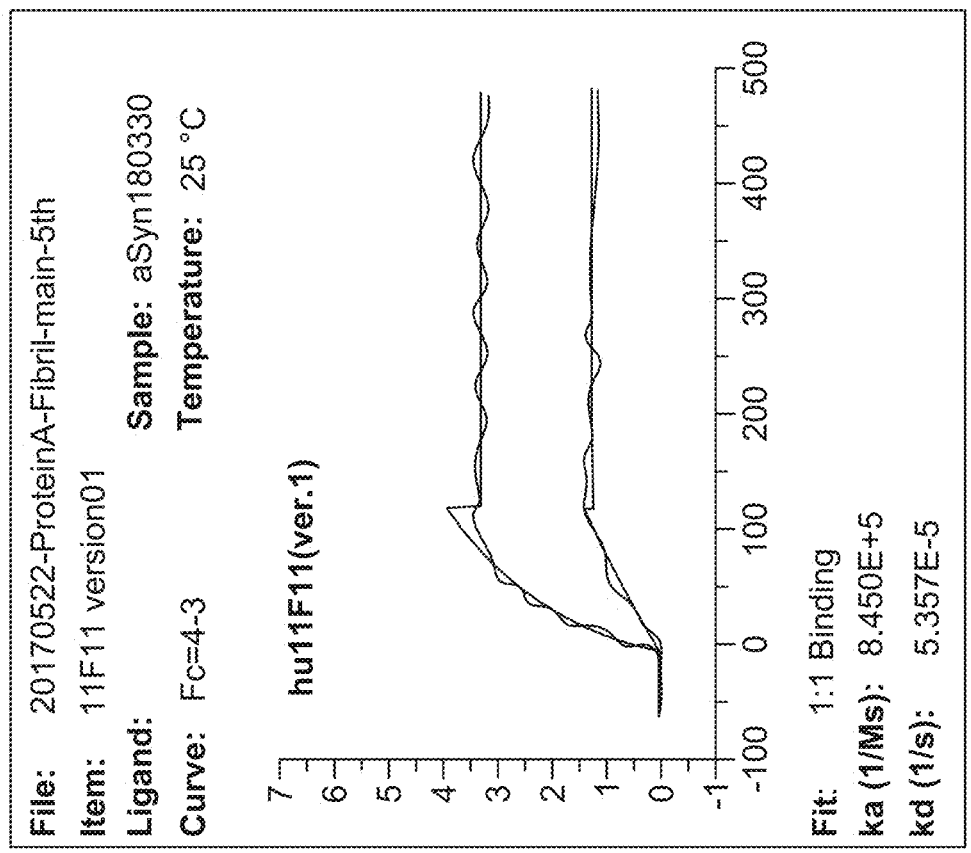
FIGS. 8A-8C show results of BIAcore analysis for the specificity and affinity of the preferential binding of the chimeric anti-alpha-synuclein antibody and humanized antibody 11F11 prepared in an embodiment of the present invention to α-syn aggregates.
Figure 8A:
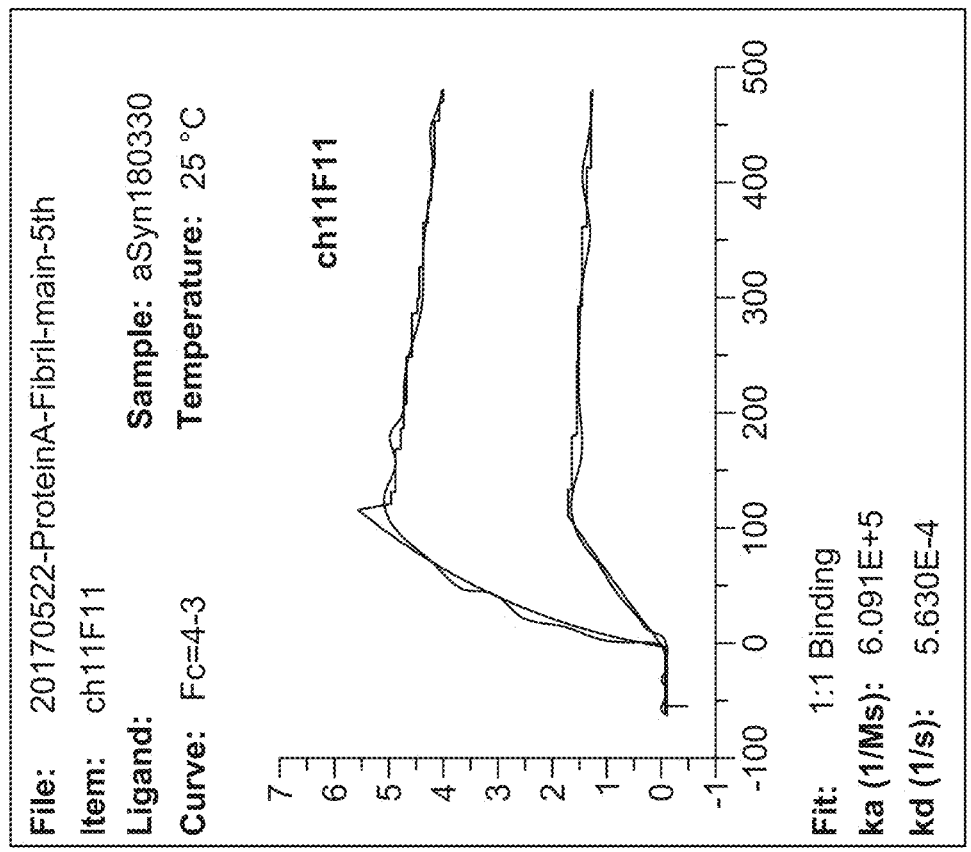
Figure 8B:
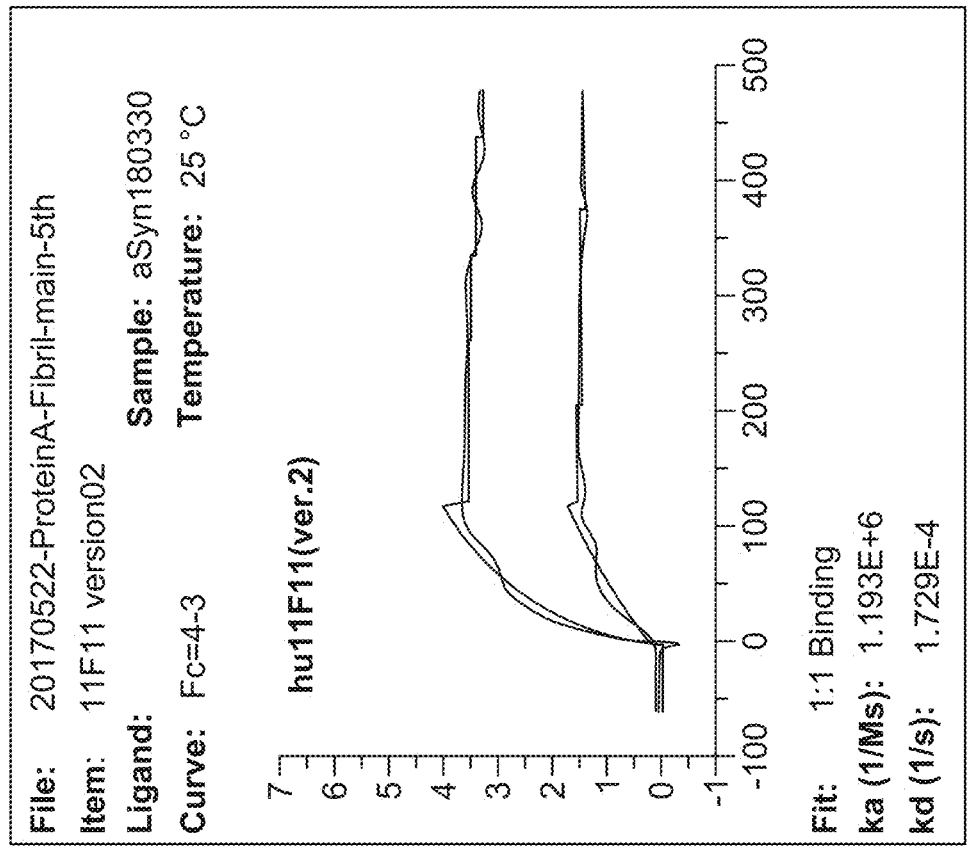
Figure 8C:
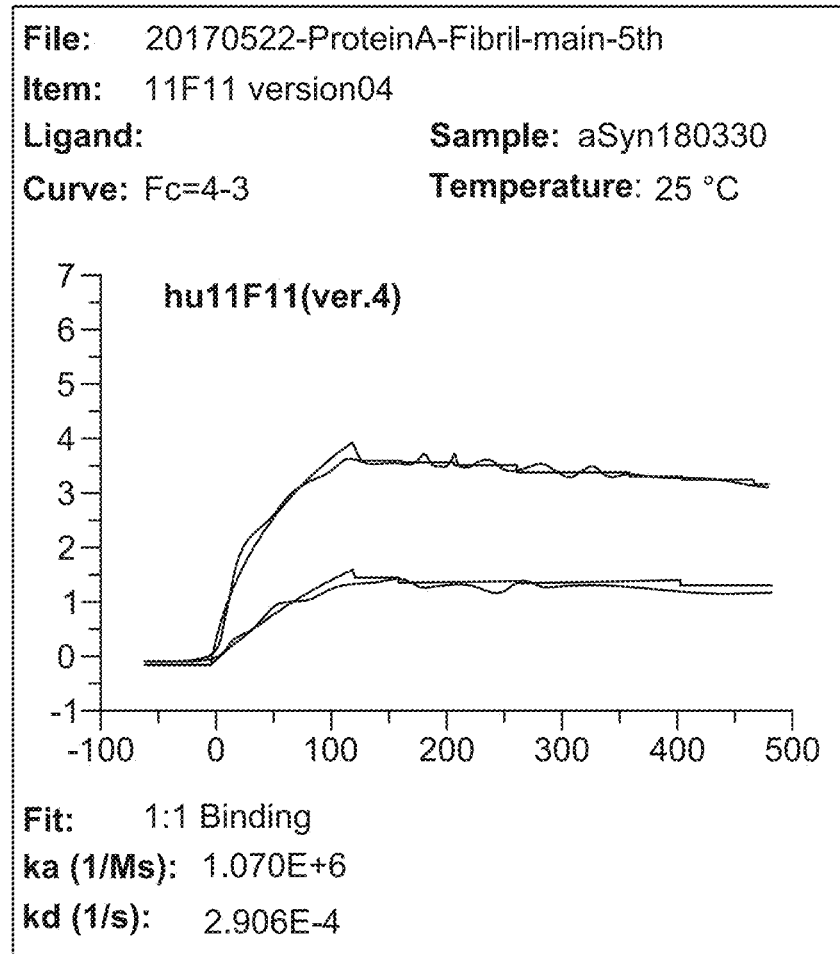

FIGS. 8A-8C show the result of measuring that the monoclonal antibodies of 3A9 and 11F11 according to an embodiment of the present invention can specifically recognize the Lewy bodies and Lewy neurites in human brain tissue, respectively. They show that the antibodies of the present invention bind to the Lewy bodies (arrow) and the Lewy neurites (thread-like shape in lower left part).

As shown in FIGS. 8A-8C, the antibody of the present invention was shown to effectively bind to the Lewy body and Lewy neurite (indicated by an arrow). These results suggest that it is able to bind effectively to the alpha-synuclein aggregate of a component of the Lewy body in human brain tissue. It is shown that the antibodies delivered to the human brain can effectively and specifically bind to the alpha-synuclein aggregate. These results indicate that the antibodies of the present invention can specifically bind to alpha-synuclein aggregates in human brain tissue actually, and can be effectively used for the prevention and/or treatment of diseases associated with alpha-synuclein etiology.

Example 6. Epitope Analysis of Anti-Alpha-Synuclein Antibody

Figure 6:
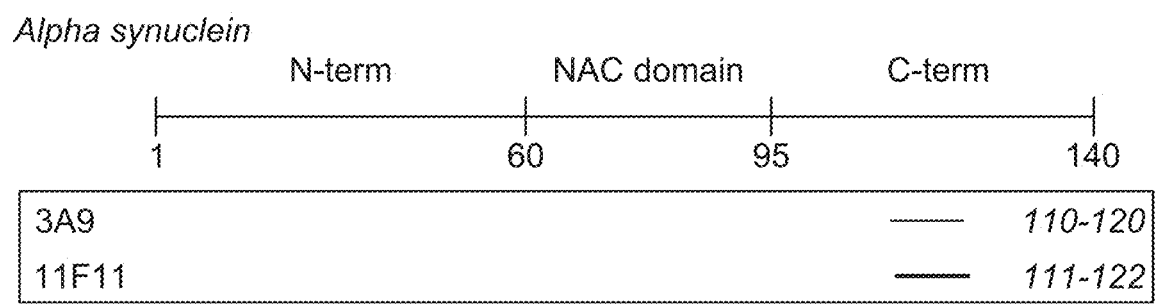
FIG. 6 is a schematic representation of the epitope mapping results for the anti-alpha-synuclein antibodies of an embodiment of the present invention, in which the antibodies of the present invention bind mostly to the C-terminal region.

The epitope mapping for 3A9 and 11F11 antibodies as chimeric antibodies obtained in Example 2 was performed by requesting PEPSCAN (The Netherlands) for peptide allele analysis. The results are shown in FIG. 6. FIG. 6 is a schematic representation of the epitope mapping results for the antibodies of an embodiment of the present invention.

As shown in FIG. 6, most of the antibodies of the present invention have been shown to bind to the C-terminal region. The alpha-synuclein antibodies recognizing the N-terminus could not recognize the aggregates of other diseases, such as multiple system atrophy belonging to synucleinopathies which collectively refer to alpha-synuclein-related diseases. In contrast, the alpha-synuclein antibodies recognizing the C-terminal region have an advantage in recognizing the aggregates of other various synucleinopathies as well as Parkinson's disease. Particularly, as described above, the antibodies recognizing the region between 110 and 122 residues have been shown to preferentially bind to the aggregates.

Example 7. ELISA Analysis Using Anti-Alpha-Synuclein Antibody

Sandwich ELISA was performed to quantitatively analyze the binding affinity of the chimeric antibodies (Ch11F11) obtained in Example 2, and the humanized antibodies (Hu11F11) obtained in Example 3, according to the substantially same method of Example 4-2.

Specifically, each antibody was diluted at 1/10 ratio of concentrations 0.04 to 400 nM and was coated on a 96-well plate, and then each well was treated with synuclein fibril aggregates were treated at 2000 ng/mL. After washing with 1×PBS, streptavidin conjugated with HRP and secondary antibody conjugate with biotin was treated and then reacted with TMB as a substrate. The absorbance was measured. The results are shown in FIG. 7.

Figure 7:
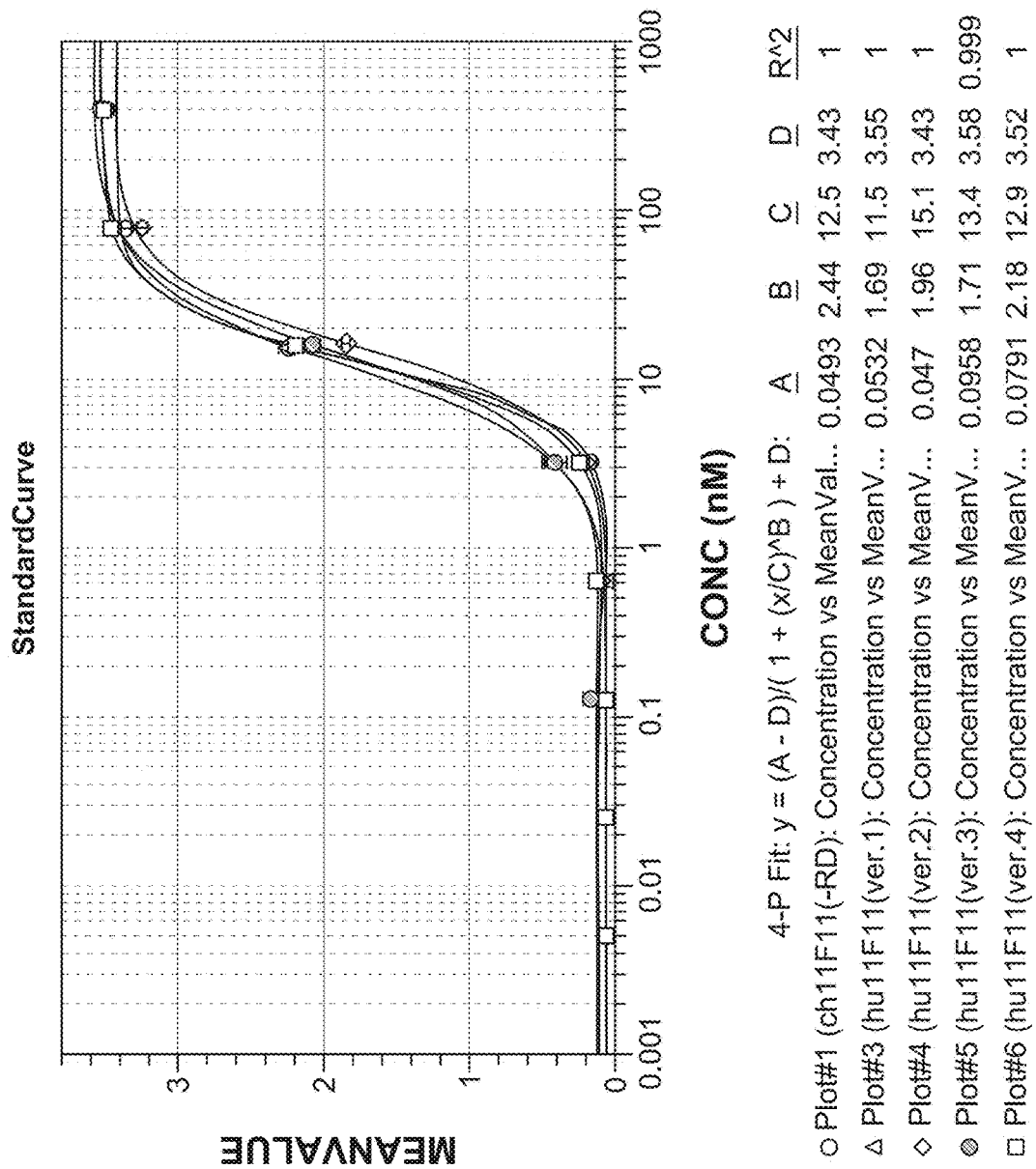
FIG. 7 is a result of ELISA analysis for the affinity of the chimeric anti-alpha-synuclein antibody and humanized antibody 11F11 prepared in an embodiment of the present invention.

As shown in FIG. 7, it was confirmed that the humanized antibodies according to the present invention, in particular humanized antibodies derived from chimeric 11F11 (humanized 11F11 antibodies), exhibit equivalent binding affinity to the chimeric 11F11 clone. It was confirmed that humanized antibodies, especially the humanized antibody derived from chimeric 11F11 such as hu11F11 (ver.1) including a combination of Hu11F11-VH-v1 and Hu11F11-VLv3 4c, hu11F11 (ver.2) including a combination of Hu11F11-VH-v2 and Hu11F11-VLv3 4c, hu11F11 (ver.3) including a combination of Hu11F11-VH-v3 and Hu11F11-VLv3 4c, hu11F11 (ver.4) including a combination of Hu11F11-VH-v4 and Hu11F11-VLv3 4c exhibited equivalent binding affinity to the chimeric 11F11, and the $EC_{50}$ was 11.5 to 15.1 nM, which showed similar to that of 12.5 nM $EC_{50}$ of the chimeric 11F11 antibody.

Example 8: BIAcore Analysis Using Anti-Alpha-Synuclein Antibody

The BIAcore analysis was performed to quantitatively analyze the binding affinity of the chimeric antibodies (Ch11F11) obtained in Example 2, and the humanized antibodies (Hu11F11) obtained in Example 3, according to the substantially same method of Example 4-3. The analysis result is shown in FIGS. 8A-8C and the following table.

TABLE 18

| Clone name | $K_D$ (nM) |
|---|---|
| Ch11F11 | 0.02472 |
| Hu11F11(ver.2) | 0.0596 |
| Hu11F11(ver.3) | 0.0316 |
| Hu11F11(ver.4) | 0.0204 |

As a result, the humanized antibodies of the present invention, especially variants of clone 11F11, namely hu11F11(ver.2) (combination of Hu11F11-VH-v2 and Hu11F11-VLv3 4c), hu11F11(ver.3) (combination of Hu11F11-VH-v3 and Hu11F11-VLv3 4c), or hu11F11 (ver.4) (combination of Hu11F11-VH-v4 and Hu11F11-VLv3 4c) showed $K_D$ values similar to that of chimeric 11F11 clone. The humanized clones as the binding affinity showed $0.02$~$0.06 \times 10^{-9}$ M of $K_D$, and chimeric 11F11 clone showed $0.02 \times 10^{-9}$ M of low $K_D$. That is, the humanized clones showed high binding affinity to the aggregates.

Example 9. Evaluation of Specific Binding to Alpha-Synuclein by the Chimeric Antibody 9-1: ELISA Analysis for Beta-Synuclein and Gamma-Synuclein After producing three chimeric antibodies of 3A9, 9B11 and 11F11 according to Example 2, the binding specificities of the antibodies to alpha-synuclein were compared with ELISA analysis results of beta-synuclein and gamma-synuclein, which were homologs of alpha-synuclein.

To perform the evaluation, each of human beta-synuclein (Uniprot: Q16143) proteins (CUSABIO, Cat: CSB-EP624090HU) and human gamma-synuclein (Uniprot: 076070) proteins (CUSABIO, Cat: CSB-EP021915HU) was coated on 96-well plate at the concentration of 100 ng/ml, washed and then blocked with 5% BSA for 2 hours. At this time, pan-syn antibody (SantaCruz, Cat: FL-140, sc-10717, rabbit) that binds to all alpha-synuclein, beta-synuclein, and gamma-synuclein was used as positive control. After washing, the chimeric antibodies (3A9, 9B 11, 11F11) diluted to 1/10 concentration of 400 nM to 0.04 nM, were treated for 2 hours, washed with PBS, and then were treated with lRP-bound goat anti-hFc antibodies as detection antibodies. After that, the absorbance was measured at 450 nm and 650 nm after reacting with TMB as a substrate. For the positive control, RP-bound goat anti-rabbit was used as a detection antibody.

Figure 9A:
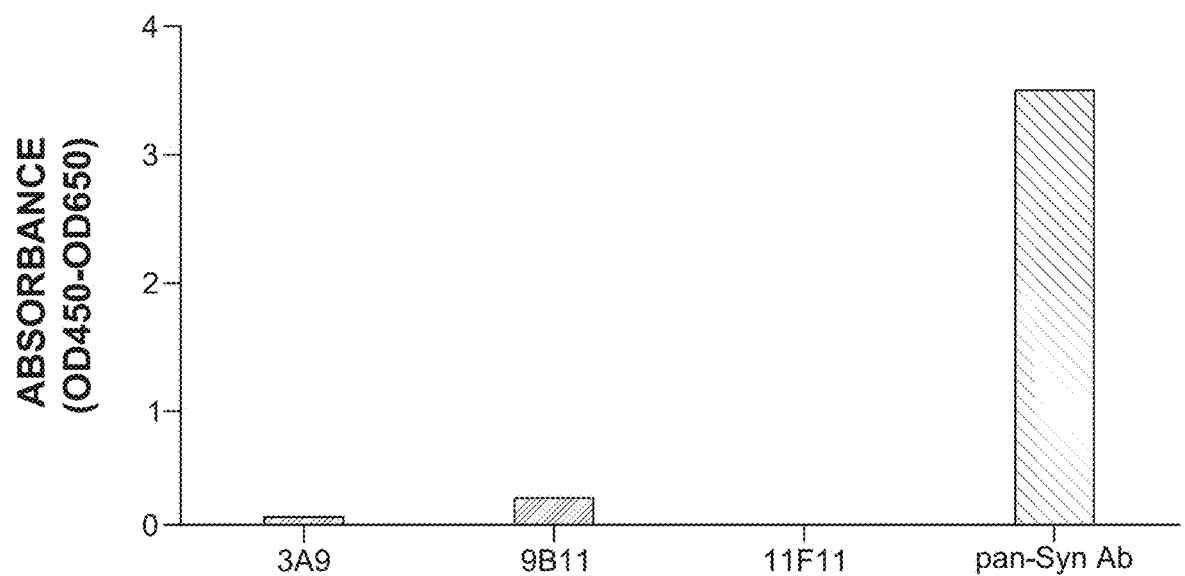
FIGS. 9A and 9B and FIG. 10 are a dot-blot result and ELISA analysis result showing the specificity that the chimeric alpha-synuclein antibody prepared in an embodiment of the present invention specifically binds to alpha-synuclein, especially alpha-synuclein aggregates but not beta-synuclein, gamma-synuclein, amyloid beta1-42, or tau-driven.
Figure 9B:
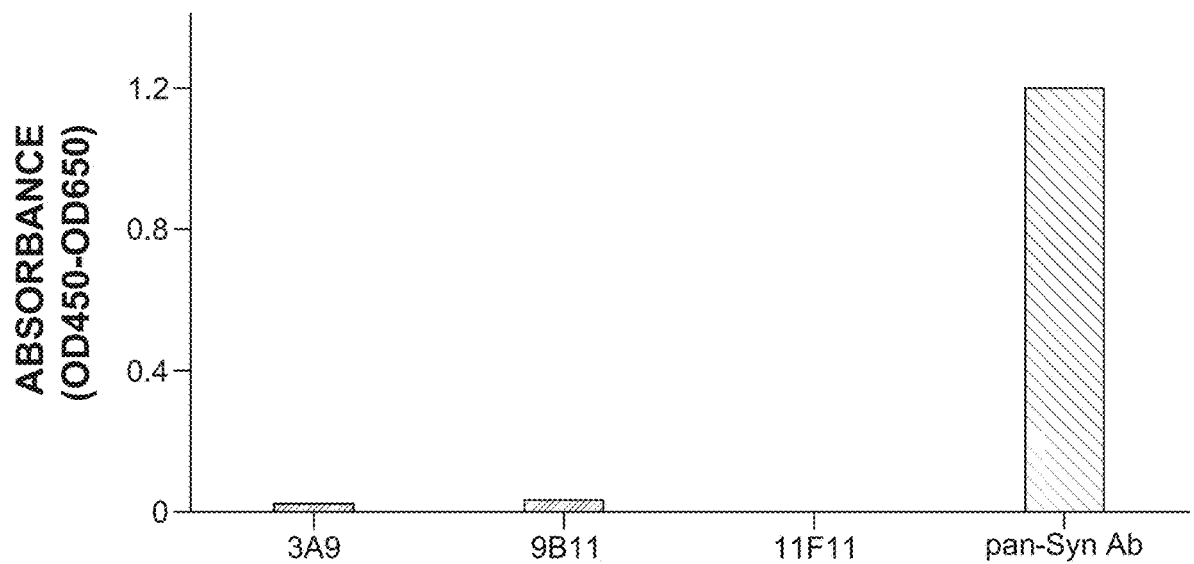

The experimental results are shown in FIGS. 9A and 9B. They are ELISA analysis results showing that the chimeric antibodies (3A9, 9B 11, 11F11) have very low binding affinities to human beta-synuclein and human gamma-synuclein. In contrast, the pan-syn antibody as a positive control showed high binding affinities to beta-synuclein and gamma-synuclein. FIG. 9A relates to human beta-synuclein, and FIG. 9B relates to human gamma-synuclein.

9-2: Dot Blot Analysis for Beta-Amyloid and Tau Aggregates

Three types of chimeric antibodies 3A9, 9B 11, and 11F11 obtained in Example 2 were reacted with the aggregates of amyloid beta$_{1-42}$ (Uniprot: P05067; CAS number: 107761-42-2) and Tau protein (Uniprot: P10636-8) proteins. The specific binding ability of the antibodies to the alpha-synuclein aggregate was analyzed by reacting with a blot. The reason for this is as follows.

Amyloid beta$_{1-42}$ and tau form aggregates, which are thought to be important etiologies for neurodegenerative diseases, especially Alzheimer's disease, and the aggregates had oligomers, protofibrils, and fibrils, like the alpha-synuclein aggregates. Therefore, the dot blot confirms that the chimeric antibodies 3A9, 9B11, and 11F11 recognize specific sequence of alpha-synuclein and do not recognize the common structure of the aggregates derived from alpha-synuclein, amyloid beta, and tau.

The dot blot method of this example was carried out in substantially the same manner as in Example 4-3, and recombinant amyloid beta$_{1-42}$, tau protein, and aggregates thereof were prepared by Professor Seung-jae Lee of Seoul National University. Syn-1, 6E10, and Tau5 are antibodies known to bind to alpha-synuclein, amyloid beta$_{1-42}$, and tau proteins, respectively. The results of the analysis are shown in FIG. 10.

Figure 10:
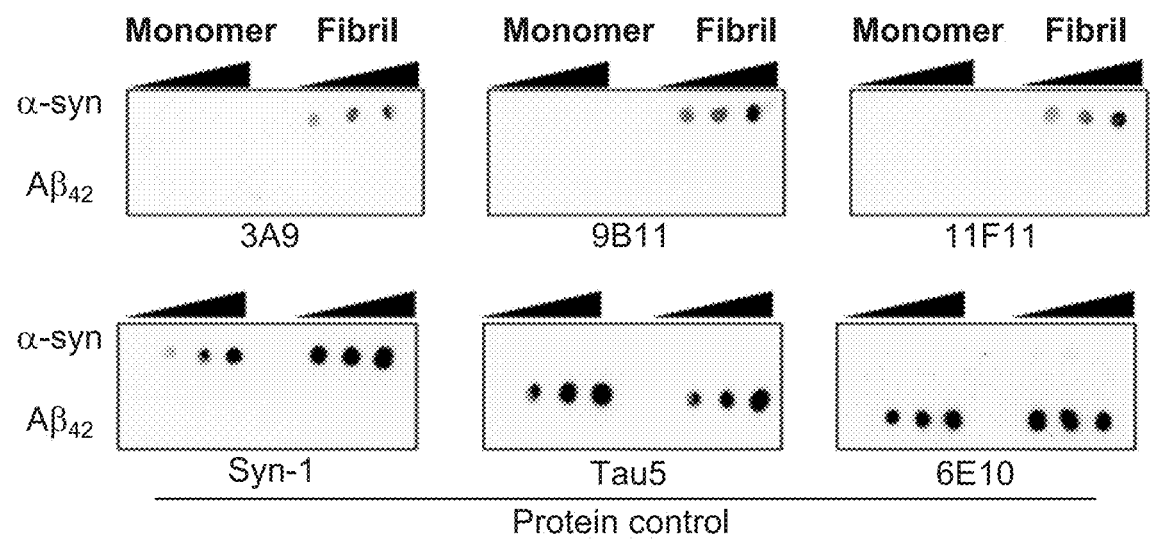

The results of the experiment are shown in FIG. 10, which indicates that the chimeric antibodies 3A9, 9B111, and 11F11 of the present invention specifically bind only to alpha-synuclein-derived aggregates and not to amyloid beta$_{1-42}$ and tau-derived aggregates. In contrast, 6E10 and Tau5 antibodies, known to bind to amyloid beta$_{1-42}$ and Tau, respectively, showed binding to the corresponding aggregates on a dot blot.

According to the above results, the chimeric antibodies do not bind to the homolog of alpha-synuclein and aggregates derived from different proteins, but efficiently bind to only target protein. It suggests that it can be superior efficacy to the antibodies or drugs which bind to the homologs and the aggregates derived from the different proteins.

Example 10. Production of Bispecific Antibody 10-1: Bivalent Bispecific Antibody Cloning In order to construct a bivalent bispecific antibody expression vector, an antibody nucleotide sequence including a signal sequence was inserted into a multi cloning site (MCS) of the pcDNA3.4 vector (Invitrogen). The bispecific antibody expression vector was a monocistronic vector, and heavy chain expression vectors and light chain expression vectors were prepared, respectively.

As the heavy chain sequence inserted to the heavy chain expression vector, the anti-IGF1R scFv was linked via a linker to C-terminus of the immunoglobulin where the heavy chain variable region encoding the anti-alpha-synuclein antibody and the human heavy chain constant region were linked. As the light chain sequence inserted to the light chain expression vector, the light chain variable region encoding the anti-alpha-synuclein antibody and the human light chain constant region were linked.

10-2: Monovalent Bispecific Antibody Cloning

Monovalent bispecific antibody was a heterodimer comprised of a heavy chain (hole) of an anti-alpha-synuclein immunoglobulin in which the anti-IGF1R scFv was linked at C-terminus, and a heavy chain (knob) of an anti-alpha-synuclein immunoglobulin which the scFv was not linked, and a light chain conjugated to the heterodimer.

In order to increase the conjugation efficiency of heavy chain heterodimer, knob-in-hole technique was used. That is, the coding sequence of the heavy chain in hole type was replaced with T366S, L368A, and Y406V in the CH3 portion, and the coding sequence of the heavy chain in knob type was substituted with amino acid with T366W in the CH3 portion.

10-3: Transient Expression

The prepared vector was performed with maxi-prep (Qiagen) to obtain a large amount of plasmid DNA. Then, they were introduced into cells as follows. In order to produce the monovalent BsAb, the expression vector DNA for the heavy chain and the expression vector DNA for the light chain were transfected at a ratio of 1:1. To produce monovalent BsAb, the expression vector DNA for the heavy chain in hole type, the expression vector DNA for the heavy chain in knob type, and the expression vector DNA for the light chain were transfected at a ratio of 0.5: 0.5: 1.

At the day before transfection, the concentration of 3×10E6 to 4×10E6 viable cells/mL of ExpiCHO™ (Gibco, Cat: A29127) cells was adjusted in ExpiCHO™ expression medium (Gibco, Cat: A29100-01) medium, and then incubated at 8% $CO_2$, 37° C. and 120 rpm for 1 day. On the day of DNA transfection, the cells grown to 7×10E6 to 10×10E6 viable cells/mL and having survival rates of 95% or more were diluted to 6×10$^6$ viable cells/mL with using fresh medium.

In order to transfect the parent cells, ExpiFectamine™ CHO and plasmid DNA complex was prepared by using the ExpiFectamine™ CHO transfection kit (Gibco, Cat: A29129). Each of DNA and ExpiFectamine™ CHO reagents were prepared at appropriate concentrations and inoculated on the old OptiPRO™ SFM® (Gibco, Cat: 12309019) medium which were dispensed and mixed to leave at room temperature for 5 minutes. The product was inoculated into parent cells, and began to culture after transfection. The day after transfection, the enhancer and feed included in the ExpiFectamine™ CHO transfection kit were inoculated into transfected cells, and after 5 days, the feed was additionally inoculated and incubated for 10 days at 8% $CO_2$, 37° C., and 120 rpm to produce the transfected cells.

10-4: Medium Harvest

In order to obtain the culture solution of the completed production, the culture medium was transferred to a centrifuge bottle for centrifugation and centrifuged at 4° C. and 6500 rpm for 30 minutes, followed by filtering with a filter having a size of 0.2 m to obtain a culture medium with removing suspended solids. Then, the obtained culture medium was used for subsequent purification.

Example 11. Production of IGF1R Antibody (scFV)

11-1: Preparation of IGF1R Antibody (scFV)

The monoclonal antibodies were prepared by using the phage display/panning technique. Specifically, the antigens used in the phage display panning and other analysis were used as the following proteins. The peptide consisting of 31 to 932 residues of the amino acid sequence of SEQ ID NO: 410, in which the signal sequence was excised from the extracellular domain of human IGF1R, was tagged with Histidine at C-terminus and used for this example (R&D Systems, USA, 391-GR). Monkey IGF1R (National Research Council Canada), mouse IGF1R (R&D systems, 6630-GR/CF), and rat IGF1R (National Research Council Canada) with His tag at C-terminus were used as an antigen for testing the interspecific cross-reactivity. $1 \times 10^{10}$ of the scFv (Single-chain variable fragment) library cells with diversity which were derived from human (prepared by SHIM Hyunbo at Ehwa Womon's University) were inoculated in 2×YT medium [17 g of Tripton (CONDA, 1612.00), 10 g of yeast extract (CONDA, 1702.00) and 5 g of NaCl (Sigma, S7653)] containing 34 µg/mL of chloramphenicol (Sigma, C0857), 2% glucose (Sigma, G5400) and 5 mM MgCl2 (Sigma, C0857) at 30° C. for 3 hours to be OD600 of 0.5 to 0.7. Then, the cells were infected with a helper phage, and cultured in 2×YT medium containing 34 µg/ml of chloramphenicol, 5 mM MgCl2, 70 µg/mL of kanamycin (Sigma, K1876) and 1 mM IPTG (ELPISBIO, IPTG025) at 30° C. for 16 hours to induce the phage packing. Subsequently, the culture solution was centrifuged at 4500 rpm at 4° C. for 15 minutes. The supernatant was added with 4% PEG 6000 (Fluka, 81253) and 3% NaCl (Sigma, S7653) and incubated for 1 hour on ice. The product was centrifuged at 8000 rpm for 20 minutes at 4° C., and then, the pellet was suspended in PBS and centrifuged again at 4° C. and 12,000 rpm for 10 minutes to obtain a supernatant containing the phage library. The obtained supernatant was stored at 4° C. until the subsequent use.

11-2: Phage Display Panning

In order to screen the human IGF1R antibody, panning was performed at three rounds according to the following. The phage library was synthetic human scFv library and the procedure of phage display panning and the result are shown in Table 19.

TABLE 19

| Step | | Panning | |
|---|---|---|---|
| | 1 round | 2 round | 3 round |
| Antigen | IGF1R ECD (biotinylated) | IGF1R ECD (biotinylated) | MCF-7 cell |
| Coating method | Indirect Immobilization | Indirect Immobilization | — |
| Input | $7.0 \times 10^{12}$ | $6.0 \times 10^{12}$ | $5.0 \times 10^{12}$ |
| Output IGF1R or MCF-7 | $4.9 \times 10^{8}$ | $3.3 \times 10^{5}$ | $1.2 \times 10^{5}$ |
| washing PBS-T** | 5 times | 10 times | 10 times |
| PBS | 2 times | 2 times | 2 times |

Specifically, 1 mL of recombinant human IGF1R protein at a concentration of 5 µg/mL (R&D Systems, USA, 391-GR or Sino Biological Life Technologies, USA, 10164-H08H-50R) was added to an immunotube (MaxiSorp 444202) and coated on the surface of immuotube at 4° C. for 16 hours. Then, the supernatant was removed and incubated with the addition of PBS containing 3% of BSA at 37° C. for 1 hour to block the non-specific binding by binding the BSA to the surface unbound by IGF1R. After removing the supernatant, the phage library prepared in Example 11-1 mixed with BSA 1.5% solution was put into the immunotube and reacted at 37° C. for 1 hour to allow the IGF1R specific phage to bind to antigen. Then, the product was washed with PBS-T solution (phosphate buffered saline-0.05% Tween 20) to remove the phage binding non-specifically, and the phage binding to IGF1R was collected with 100 mM triethylamine solution.

The collected phage was neutralized with 1M Tris buffer solution (pH 7.4) and transfected with E. coli K12 ER2738 at 37° C. for 1 hour, and the infected E. coli was spread out on LB agar medium containing tetracycline and carbenicillin, and cultured at 37° C. overnight. Next day, the cultured E. coli was suspended in a 5 ml of SB (superbroth) medium containing tetracycline and carbenicillin and was added by 50% glycerol at the same volume. One part was stored at −80° C., and 50 µL of product was suspended in 40 ml of SB (superbroth) medium containing tetracycline and carbenicillin, added with $10^{12}$ PFU of VCSM13 helper phage and cultured with stirring at 37° C. for 1 hour. Then, the culture solution was added by Kanamycin and cultured at 30° C. for about 16 hour, so as to culture only E. coli infected with the helper phage.

The next day, after centrifuging the culture solution, the supernatant was taken, and added to a buffer containing 4% PEG8000 and 3% sodium chloride (NaCl), reacted at 4° C. for about 1 hour, and the phage was precipitated and centrifuged. After removing the supernatant, the precipitated phage pool was re-suspended in PBS buffer containing 1% BSA, and was used for the next round of panning. As the panning round progressed, the number of washing using PBS-T was increased to amplify and concentrate the antigen-specific phage.

11-3: Single Clone Screening

The cell clones showing the binding affinity to ECD (extracellular domain) of human IGF1R and MCF-7 expressing IFG1R were selected.

Specifically, to select the monoclonal antibodies specifically biding to IGF1R from the phage pool obtained in Example 11-2, the following experiment was performed.

In order to separate the monoclones from the concentrated pool, the phage pool obtained on the LB-tetracycline/carbenicillin agar medium was smeared and cultured to secure a single colony. After inoculating these colonies in a 96-deep well plate and incubating overnight, 10 µL of the culture solution was re-inoculated into the 96-deep well plate and incubated at 37° C. for about 4 hours in the same manner to obtain an appropriate OD (0.5 to 0.7). After adding 20 MOI helper phage to the culture solution, the mixture was reacted at 37° C. for 1 hour. Thereafter, kanamycin was added to the culture medium, and cultured overnight at 30° C. On the next day, the culture medium was centrifuged and the supernatant was taken to perform ELISA to select IGF1R-specific phage (Steinberger. Rader and Barbas III. 2000. Phage display vectors. In: Phage Display Laboratory Manual. 1st ed. Cold Spring Harbor Laboratory Press NY.USA. Pp.11.9-11.12).

100 ng of recombinant IGF1R was added to each well in an ELISA plate, and reacted at 4° C. for about 15 hours to coat the antigen on the plate. To prevent non-specific binding, PBS buffer containing 3% BSA was added at 200 µL per well, and then reacted at 37° C. for about 1 hour. The supernatant was discarded.

100 µL of the solution containing the prepared monoclonal phage was put in each well, reacted at 37° C. for 1 hour, and washed 3 times with 300 µL of PBS-T. To detect the phage bound to the IGF1R antigen, the anti-HA HRP was diluted 1: 5000 in PBS buffer containing 3% BSA, and reacted at 37° C. for 1 hour. After washing with 300 µL of PBS-T at 3 times, 100 µL of TMB (Tetramethylbenzidine, Sigma, T0440) was added to develop color, and 50 µL of 1N $H_2SO_4$ was added to quench the reaction. By measuring the absorbance at 450 nm, the clones with high absorbance compared to the control group of BSA were selected as antigen-specific antibody clones.

Seven (7) kinds of 1564, 48G5, 49G11, 54H4, 60A11, 60H6, and B11 clones were selected by screening twice.

Example 12: Production of Affinity Variant of IGF1R Antibody

Antibodies were optimized by carrying out affinity variation for the selected clones by evaluating ligand binding capacity and BBB penetration ability. In the first trial, NNS hand-mix primers were prepared to randomize heavy chain CDR2 and light chain CDR3 based on 1564 scFv and amplified 1564 scFv gene containing randomization sequence using PCR technique. The amplified gene products were inserted into the pComb3x vector to make a library form suitable for phage display, and a number of scFv clones binding to IGF1R could be selected through the library panning and ELISA screening. For the selected clones, the amino acid sequence of the variable region was identified through gene sequencing.

In the second trial, two mini libraries were constructed for heavy and light chains that introduced germline back-mutation into CDR1, CDR2, and CDR3, respectively. By analyzing 96 colonies, it was confirmed that 31 VL clones and 39 VH clones had unique sequences. The clones were finally obtained by selecting an affinity variant based on the productivity and antigen binding affinity of the clones.

Example 13. Preparation of Antibody Variants Having the Deamidation Residue 13-1: Deamidation Residue Identification When deamidation occurs in the CDR, the antibody is degraded and becomes the weak binding to the antigen, which may lead to reduced efficacy and sample heterogeneity. The sample heterogeneity causes complexity due to its identification in clinical approvals. Therefore, it was intended to identify the location where deamidation occurs, through in silico analysis and peptide mapping.

As shown in FIG. 18A, the occurrence of actual deamidation was identified by in silico analysis and peptide mapping of the parental 1564 clone. In this regards, the samples were stored at 4° C. or 40° C. for one week before analysis, and it was confirmed that deamidation occurred in L-CDR2, L-CDR3, and H-CDR2. The affinity variants disclosed in Example 12 were also analyzed to confirm the location of deamidation.

13-2: Preparation of Antibody Variants

The parental 1564 clone had a net charge of −0.7 in in silico analysis. Normally, when the net charge is <0 or >5.5, it is considered to be vulnerable to fast clearance in the body. Therefore, if deamidation residues are replaced with positive charges such as H, R, K, etc., it is thought that the fast clearance could be prevented by deamidation removal and increased total charge. Therefore, the mutants in which the deamidation site was substituted were prepared, as shown in FIG. 18B.

In order to remove the deamidation residue, the mutant having the residue substitution was prepared as follows:
1) In the amino acid sequence, Asn was replaced with D or Q similar to Asn. If the mutant had no change in the binding affinity, all the residues are replaced with Q.
2) Because the net charge of the parental clone was −0.7 and the net charge causing fast clearance is ≤0 or >5.5, it is advantageous as the charge becomes positive.

Therefore, N95a, the deamidation residue of LCDR3, was replaced with H, R, and K having positive charge.

Example 14. Preparation of Various Forms of Anti-IGF1R Antibodies 14-1: Preparation of Anti-IGF1R Minibody A minibody was prepared by connecting the whole scFv of the IGF1R specific monoclonal phage antibody obtained in Examples 11 to 13 to the C-terminus of Fc. To do so, the nucleotide sequence encoding the amino acid sequence of scFv disclosed in the present invention was prepared, and the nucleotide sequence was cleaved with a restriction enzyme and cloned into a pcDNA-based expression vector containing a nucleotide sequence encoding Fc.

14-2: Preparation of Anti-IGF1R Bivalent Antibody

The entire scFv of the IGF1R specific monoclonal phage antibody obtained in Examples 11 to 13 was prepared and two entire scFv were linked to each C-terminal of the therapeutic antibody in an IgG form to obtain bivalent antibody. To do so, the nucleotide sequence encoding the amino acid sequence of scFv disclosed in the present invention was prepared, cleaved with a restriction enzyme, and cloned into a pcDNA-based expression vector containing a nucleotide sequence encoding a therapeutic antibody.

14-3: Preparation of Anti-IGF1R IgG (Full-IgG) Antibody

In order to convert the sequences of 1564 antibody and F06 antibody to full IgG1 (Full IgG) form among the IGF1R specific monoclonal phage antibodies obtained in Examples 11 and 12, the nucleotide sequences of heavy chain and light chain regions were synthesized (Genotec Inc.).

14-4: Preparation of Anti-IGF1R scFv Monovalent Antibody

Example 14-1 is a minibody form in which the scFv form of anti-IGF1R antibody is bound to each C-terminal of the two Fc of the heavy chain. In this example, one scFv is bound to C-terminus of only one Fe in a heavy chain. In the form of the antibody obtained in Examples 11 to 13, a vector in which 1564, F06, C04, VH5, VH16, VH35, VH9, VH2, VH7, and VH32 of the IGF1R specific monoclonal phage antibody was bound to the C-terminus of only one Fc, and a vector having no anti-IGF1R antibody bound to C-terminus were constructed. The knob-into-hole mutation was introduced into the Fc regions to produce a heteromeric form, when producing antibodies in cells. When transfecting into CHO-S cells for antibody production, all three vectors including the vector corresponding to the heavy chain in which the anti-IGF1R antibody was bound to C-terminus of Fc in the therapeutic antibody, the vector corresponding to the heavy chain in which the anti-IGF1R antibody was not bound to the C-terminus of Fc in the therapeutic antibody, and the vector corresponding to the light chain for the therapeutic antibody, were injected into the CHO-S cells.

14-5: Expression and Purification of Anti-IGF1R Various Antibodies

The vectors prepared in Examples 14-1 to 14-4 were introduced into cells as follows.

Specifically, CHO-S cells were adjusted to a concentration of $1.5 \times 10^6$ cells/mL in CD-CHO (Gibco, 10743) medium, and then cultured at 8% $CO_2$ at 37° C. for 1 day. On the day of DNA transfection, the cells grown to 2.5 to $3 \times 10^6$ cells/mL were prepared at a concentration of $2.1 \times 10^6$ cells/mL using CD-CHO medium containing 1% DMSO, and then were cultured under the condition of 8% $CO_2$, 37° C. for 3 hours. After centrifugation at 3000 rpm for 15 minutes, the supernatant was removed and re-suspended in RPMI 1640 medium with 2.5% FBS.

Subsequently, the combination of the vectors was diluted in Opti-MEM medium at 1 μg/mL of medium, and PEI (Polysciences, 23966, stock concentration: 1 mg/mL) was diluted to be 8 μg per mL of culture medium. After mixing the DNA and PEI mixtures and leaving the mixture at room temperature for 10 min, the mixture was poured in a flask containing cells and incubated for 4 hours at 5% $CO_2$, 37° C., 100 rpm. Then, the mixture was cultured with addition of CD-CHO medium at the same volume as the culture volume and was incubated at 8% $CO_2$, 37° C., 110 rpm for 4 days.

The obtained culture solution was passed through an equilibration MabSelect SuRe™ (GE Healthcare, 5 mL) equilibrated by passing with an equilibration buffer (50 mM Tris-HCl, pH 7.5, 100 mM NaCl) to allow the expressed antibody to bind to the column. Thereafter, after eluting with 50 mM Na-citrate (pH 3.4) and 100 mM NaCl solution, neutralization was performed using 1M Tris-HCl (pH 9.0) so that the final pH was 7.2. Thereafter, the buffer solution was exchanged with PBS (phosphate buffered saline, pH 7.4), and when the purity was high, it was stored at −20° C. after formulation and when the additional purification was required, it was stored at 4° C. until further purification When the additional purification was required, it was purified using HiLoad Superdex 200™ (GE Healthcare, Cat. No. 28-9893-36), and could be purified using a variety of different size exclusion chromatography. After equilibrating with an equilibration buffer (1x phosphate buffered saline pH 7.4, Gibco, Cat. No. 10010-023), the primarily-purified sample was loaded on the column. The sample purified completely was stored in a frozen state at −20° C. after formulation.

14-6: Preparation of the Bispecific Antibody with Anti-Alpha-Synuclein

The anti-IGF1R antibody in scFv form according to the present invention was prepared by linking the heavy chain variable region and the light chain variable region by using the linker (SEQ ID NO: 411), and was connected to C-terminus of heavy chain constant region of the complete form IgG of the anti-alpha-synuclein antibody described in the following table by using a linker (SEQ ID NO: 412) to prepare the bispecific antibody. In this example, a monovalent antibody was prepared by linking one molecule of the scFv form of the anti-IGF1R antibody per molecule of the IgG antibody of the anti-alpha-synuclein antibody, and the bivalent antibody was prepared by linking two molecules of the scFv form of the anti-IGF1R antibody per molecule of the IgG antibody of the anti-alpha-synuclein antibody respectively. The sequences of the anti-alpha-synuclein antibody used for preparing the bispecific antibody in this example and the bispecific antibodies exemplified prepared according to the present invention are described in Table 17. The bispecific antibodies exemplified in Table 17 were used for the experiments in the subsequent example.

Example 15. Analysis of IGF1R-Specific Binding Affinity by Using Anti-IGF1R Antibody 15-1: Analysis of IGF1R-specific binding affinity by using anti-IGF1R antibody in a minibody form (ELISA)

The ELISA analysis was performed to test the binding affinity and the concentration-dependent binding of the minibody forms of the 996, 1226, 1564, and MKJP2 clones prepared in Example 14-1 to the recombinant IGF1R.

Specifically, human recombinant IGF1R, which is an antibody-binding target, is an extracellular domain (ECD), was purchased from R&D Systems (6630-GR/CF). Human IGF1R was diluted with 1 μg/mL in PBS buffer, added at an amount of 100 μL per well in 96-well ELISA plate (Nunc-Immuno Plates, NUNC, Rochester, NY), coated by reacting at 4° C. for 16 hours, and then the supernatant was removed. PBS buffer containing 3% BSA (bovine serum albumin) was added to 200 μL per well and reacted for 2 hours to block non-specific binding.

Figure 11A:
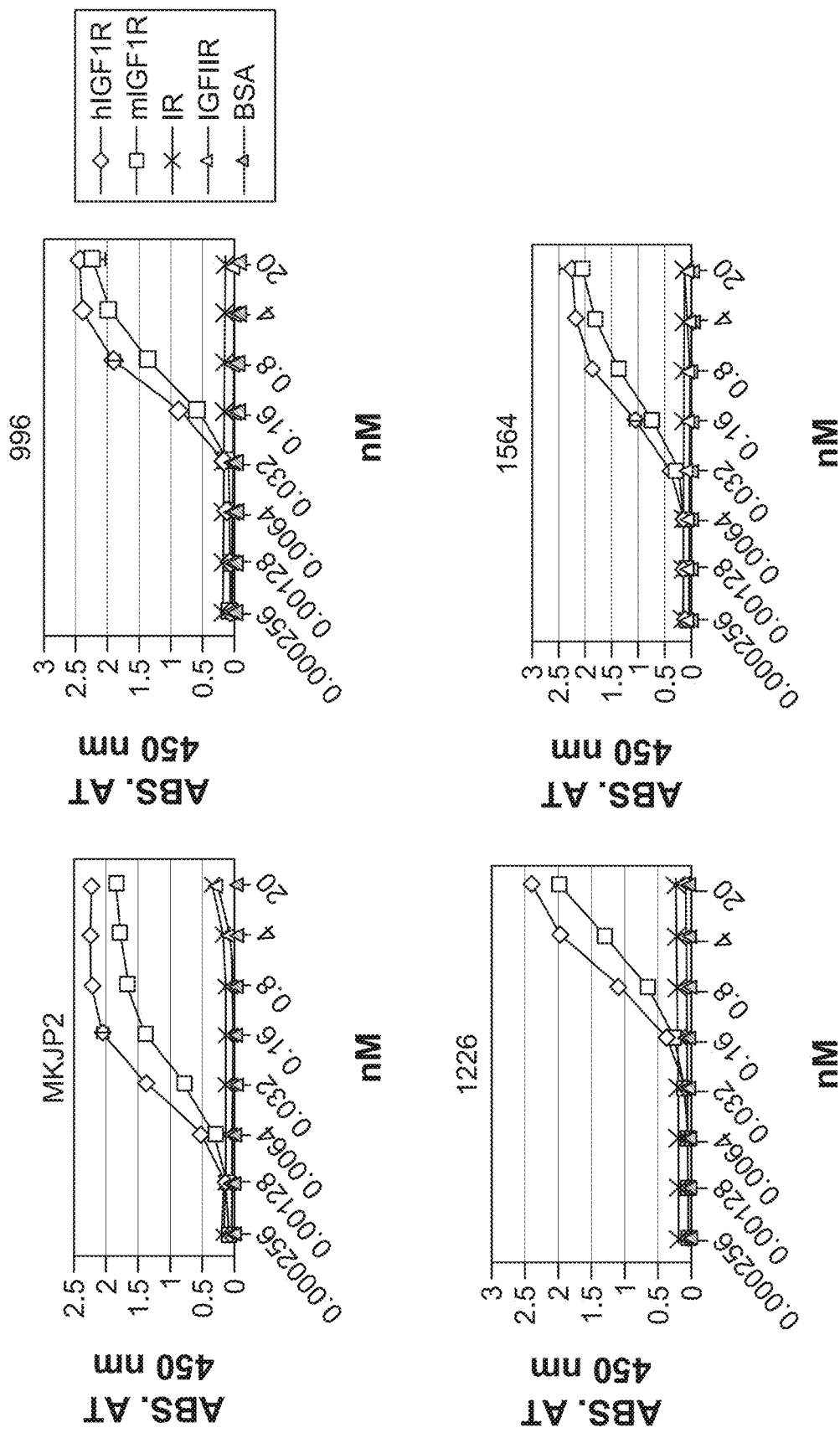
FIGS. 11A and 11B are the binding data of anti-IGF1R antibody prepared in an embodiment of the present invention to IGF1R protein.

The minibody antibodies of the 996, 1226, 1564, and MKJP2 clones prepared in Example 14-1 were diluted 3 times based on the highest concentration of 20 nM to make 12 points, and then transferred to each well 100 μL, and then treated at room temperature for 1 hour. After treatment, it was washed 4 times with PBS buffer containing 0.05% Tween20, and was reacted at room temperature for an hour by adding 100 μL of the anti-human HRP recognizing human Fc of the minibody diluted in blocking buffer at 1:5000 per each well. After washing 4 times with 300 μL of PBS-T (Tween20 0.05%), the color development was performed using TMB (Tetramethylbenzidine, Sigma, T0440). The enzymatic reaction was quenched by 0.5 mol/L of sulfuric acid, and the absorbance was recorded and analyzed at 450 nm using a microplate reader. The experimental results are shown in FIG. 11A.

It was confirmed that the four minibody clones were bound to the human IGF1R recombinant protein in a concentration-dependent manner, and specifically, MKJP2 showed the highest binding ability, and subsequently, clones 996 and 1564 showed similar binding strength, and 1226 clone showed a slightly lower binding strength.

15-2: ELISA Analysis of Interspecific Cross-Reactivity of IGF1R Antibodies

The interspecific cross-linking activity of the 1564 anti-IGF1R antibodies prepared according to the method of Example 14-2 and the anti-IGF1R antibodies obtained in Example 11-3 were analyzed by ELISA analysis. To this end, firstly, human, monkey, mouse and rat IGF1R antigens were diluted to 1 μg/mL, added to each well 100 μL, and reacted at 4° C. for 15 hours to be coated on the bottom of the plate. After removing the supernatant, 200 μL of PBS buffer containing 3% BSA was treated in each well to block non-specific binding. The anti-IGF1R antibodies were diluted by 5 times in PBSB (BSA 3% in PBS) at a maximum concentration of 400 nM, treated in each well, and reacted at 37° C. for 1 hour. Then, after washing with PBS buffer 5 times, the anti-human Fab HRP recognizing the Fab portion of the bound antibody was diluted 1:20000 was treated at 100 μL of each well, and reacted at 37° C. for 1 hour. The product was washed 5 times with PBS buffer and the color development was performed with TMB (tetramethylbenzidine, Sigma, T0440) according to the manufacturer's method. The enzymatic reaction was quenched by 0.5 mol/L sulfuric acid, and the absorbance was measured at 450 nm using a microplate reader (Molecular Devices). When many samples are used in the ELISA analysis, the plates were divided into two. The experimental results are shown in Table 12 below.

Specifically, in Table 12 of the ELISA results of bispecific antibodies to human IGF1R, the ELISA results of 1564 IgG and the bispecific antibodies to human IGF1R, mouse IGF1R, rat IGF1R, and monkey IGF1R are shown in Table 12.

The experimental results below show the advantage of evaluating efficacy using animal models of various species, and suggest that efficacy of therapeutic agents through disease models of various species can be evaluated using antibodies of the present invention.

TABLE 20

ELISA analysis results of antibody binding ability to IGF1R of various species

| Experiment | Antibody clone | $Ec_{50}$ (nM) |
|---|---|---|
| ELISA for human IGF1R | ch11F11-1564 | 0.914 |
|  | ch11F11-48G5 | 1.21 |
|  | ch11F11-54H4 | 2.88 |
|  | ch11F11-60H6 | 10 |
|  | ch11F11-B11 | 7.13 |
| ELISA for human IGF1R | 1564 IgG | 0.0823 |
|  | ch11F11-1564 | 0.379 |
| ELISA for mouse IGF1R | ch11F11 | N/A* |
|  | ch11F11-1564 | 3.02 |
|  | ch11F11 | N/A* |
|  | ch11F11-48G5 | 6.2 |
|  | ch11F11-54H4 | N/A |
|  | ch11F11-60H6 | 18.6 |
|  | ch11F11-B11 | 148 |
| ELISA for rat IGF1R | ch11F11 | N/A* |
|  | ch11F11-1564 | 1.05 |
|  | ch11F11-48G5 | 2.44 |
|  | ch11F11-54H4 | 14.2 |
|  | ch11F11-201** | N/A* |
|  | ch11F11-1564 | 0.874 |
|  | ch11F11-60H6 | 38 |
|  | ch11F11-B11 | 35.1 |
| ELISA for monkey IGF1R | ch11F11 | N/A* |
|  | ch11F11-1564 | 2.48 |
|  | ch11F11-48G5 | 6.69 |
|  | ch11F11-54H4 | 8.83 |
|  | ch11F11-201** | N/A* |
|  | ch11F11-1564 | 2.21 |
|  | ch11F11-60H6 | N/A |
|  | ch11F11-B11 | 180 |

*not available
**201: scFv form of Herceptin biosimilar 15-3: The Binding Affinity Analysis of the Affinity Variant to IGF1R (FACS)

The binding affinity of the affinity variants prepared in Example 12 was performed by ELISA for the ECD of IGF1R and the binding affinity for MCF-7 was analyzed by FACS.

As an analysis for the primary clones, Table 21 shows the results of the ELISA analysis for the ECD of IGF1R in the bispecific antibody form of the corresponding primary-selected clones, and Table 22 shows the result of analyzing the binding affinity to the MCF-7 cell line by FACS.

TABLE 21

ELISA results of the binding of the bispecific antibody forms of primary-selected clones to ECD of IGF1R

| Antibody clone | $EC_{50}$ (nM) |
|---|---|
| ch11F11-1564 | 0.442 |
| ch11F11-A06 | 1.19 |
| ch11F11-A07 | 1.2 |
| ch11F11-B02 | 0.919 |
| ch11F11-B09 | 1.08 |
| ch11F11-1564 | 0.49 |
| ch11F11-D03 | 0.666 |
| ch11F11-E06 | 0.668 |
| ch11F11-F06 | 0.467 |
| ch11F11-H04(G) | 0.67 |
| Hu3A9-1564 | 0.144 |
| Hu3A9-A02 | 0.13 |
| Hu3A9-A07 | 0.125 |
| Hu3A9-B10 | 0.156 |
| Hu3A9-B01 | 0.145 |

TABLE 21-continued

ELISA results of the binding of the bispecific antibody forms of primary-selected clones to ECD of IGF1R

| Antibody clone | $EC_{50}$ (nM) |
|---|---|
| Hu3A9-C04 | 0.107 |
| Hu3A9-E09 | 0.159 |

TABLE 22

Results of FACS analysis of binding to MCF-7 cell line

| Samples | GEOmean |
|---|---|
| $2^{nd}$ Ab only | 2.92 |
| 1564 parental | 4.09 |
| F06 | 5.02 |
| A07 | 5.06 |
| B02 | 4.54 |
| B09 | 4.29 |
| D03 | 4.09 |
| E06 | 4.24 |
| F06 | 6.33 |
| C04 | 3.88 |

As a result, F06 clone was selected as the clone having the highest binding capacity in cell binding compared to the parental clone (1564 clone) (affinity matured), and C04 clone was selected as the clone with the lowest binding capacity in cell binding compared to the parental 1564 clone (affinity reduced).

As an analysis for secondary clones, Table 23 shows the ELISA results for the binding of bispecific antibody forms of clones made in the secondary production method to the ECD of IGF1R.

TABLE 23

ELISA results of secondary-selected clones to the ECD of IGF1R

| Antibody clone | $EC_{50}$ (nM) |
|---|---|
| Hu11F11(ver.2)-1564 | 0.259 |
| ch11F11-1564 monovalent | 0.347 |
| Hu11F11(ver.2)-C04 | 0.15 |
| Hu11F11(ver.2)-F06 | 0.147 |
| Hu11F11(ver.2)-1564 | 0.864 |
| ch11F11-F06 | 0.857 |
| Hu11F11(ver.2)-VH2 | 135 |
| Hu11F11(ver.2)-VH5 | 0.366 |
| Hu11F11(ver.2)-1564 | 0.157 |
| Hu11F11(ver.2)-VH7 | 402 |
| Hu11F11(ver.2)-VH9 | 6.06 |
| Hu11F11(ver.2)-VH16 | 0.236 |
| Hu11F11(ver.2)-1564 | 0.149 |
| Hu11F11(ver.2)-VH32 | 121 |
| Hu11F11(ver.2)-VH35 | 0.167 |
| Hu11F11(ver.2)-VH27 | N/A* |

The clones to be analyzed with FACS analysis were selected as shown in Table 24, after excluding the clones having significantly lowered productivity and physical properties among the secondarily-produced clones.

TABLE 24

Clones to be analyzed with FACS analysis

| Category of binding affinity | Antibody clone | Explanation |
|---|---|---|
| Binding affinity similar to parental 1564 clone | C04 | FACS and in vivo analysis |
| | F06 | FACS and in vivo analysis |
| | VH5 | FACS and in vivo analysis |
| | VH16 | FACS and in vivo analysis |
| | VH35 | FACS and in vivo analysis |
| Binding affinity decreased by 50 times | VH9 | FACS and in vivo analysis |
| | C12 | Undesired physical properties |
| Binding affinity decreased by 50 times or more | VH2 | FACS and in vivo analysis |
| | VH6 | Undesired physical properties |
| | VH7 | FACS and in vivo analysis |
| | VH27 | Undesired physical properties |
| | VH32 | FACS and in vivo analysis |

Figures 12A, 12B:
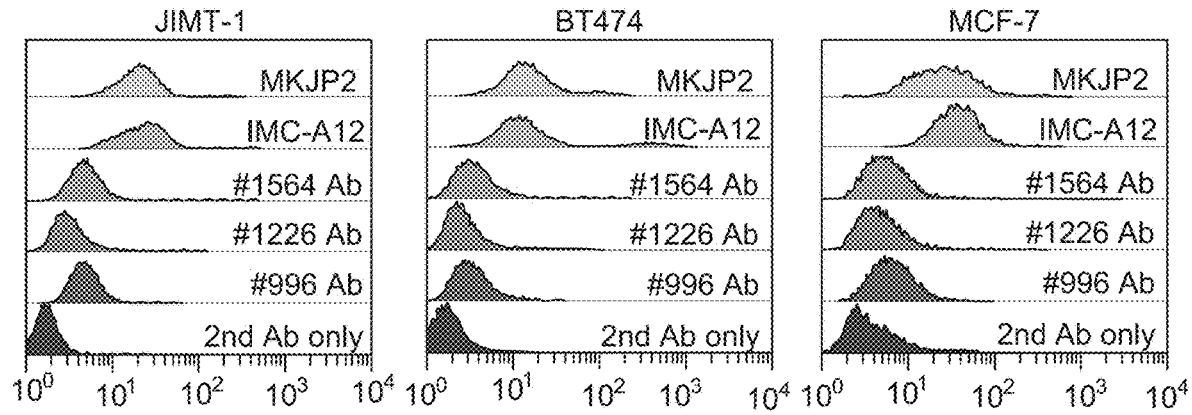
FIGS. 12A-12C show the binding data of anti-IGF1R antibody prepared in an embodiment of the present invention to cell lines expressing IGF1R.
Figure 12C:
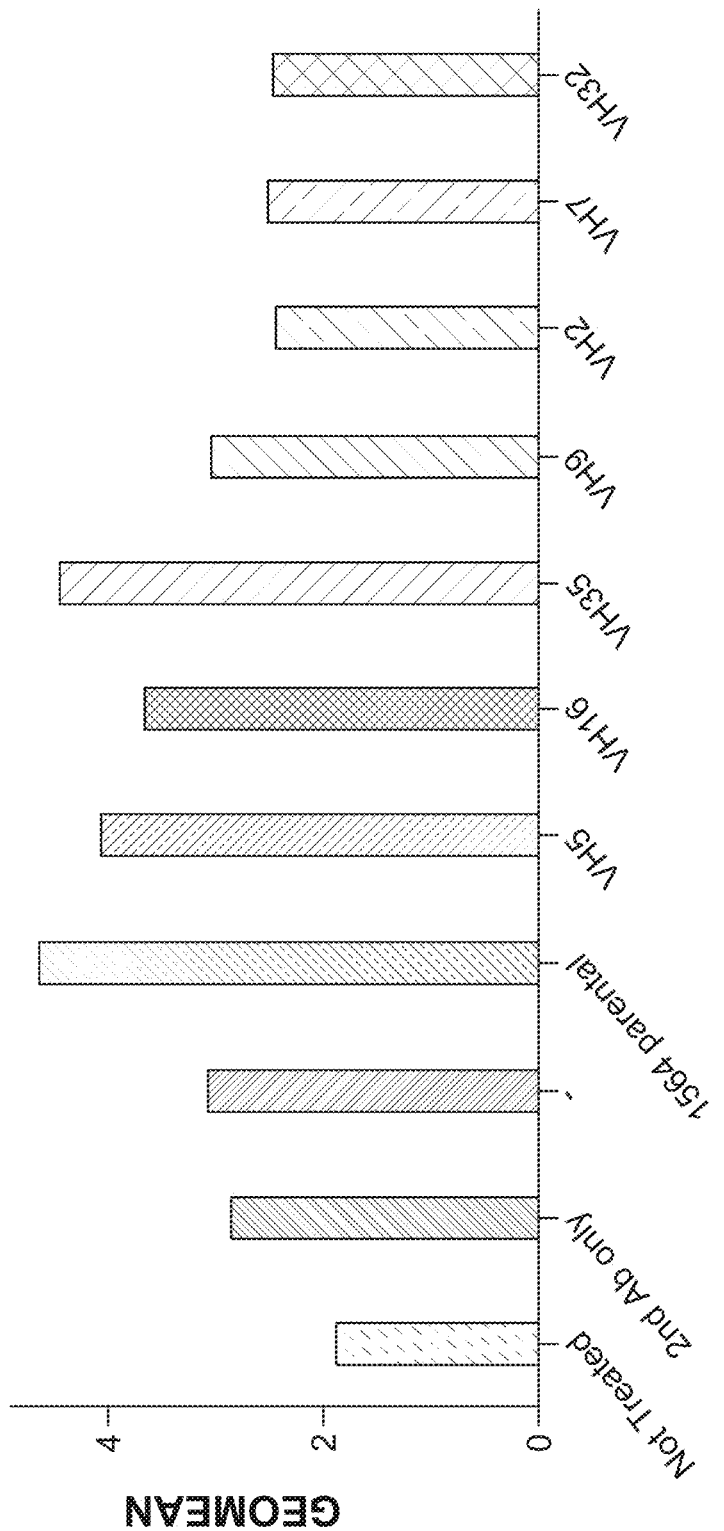

FIG. 12C is the result of analyzing the binding of the clones to the MCF-7 cell line by using FACS, and all of the analyzed clones had a lower binding affinity to MCF-7 compared to the parental clone 1564. The results show that the clones showing the decreased binding capacity in ELISA also showed decreased binding capacity in FACS.

The selected antibody clones are F06, C04, VH2, VH5, VH7, VH9, VH16 and VH32, and amino acid sequences for heavy chain variable regions and light chain variable regions for these antibodies are shown in Tables 5 and 6 above.

15-4: BIAcore Analysis for Human IGF1R

The binding capacity of the antibody according to the present invention to human IGF1R was analyzed.

For the IgG form of the 1564 clone, the degree of binding to human IGF1R was analyzed by SPR analysis. The anti-his antibody against the His tag bound to the human IGF1R ECD as an antigen was diluted to 20 μg/mL in acetate pH4.0 buffer, and then immobilized in the reference/analytic channel of the CM4 chip to 10,000 RU as a target RU according to the amine coupling method. During capture, PBS was used as a running buffer, and the flow rate was maintained at 30 μL/min. During association/dissociation, the flow rate was 40 μL/min, and PBS was used as the running buffer. The association/dissociation was 5 minutes and 20 minutes, respectively. The analysis was performed in the order of baseline 1, activation (EDC NHS), human IGF1R loading, quenching (1 M ethanolamine), baseline 2, association, and dissociation. Evaluation was performed using a bivalent model, and analyzed using Biacore™ T200 Evaluation software (version 1.0, S/N: 04Y15×11-0149).

Figure 11B:
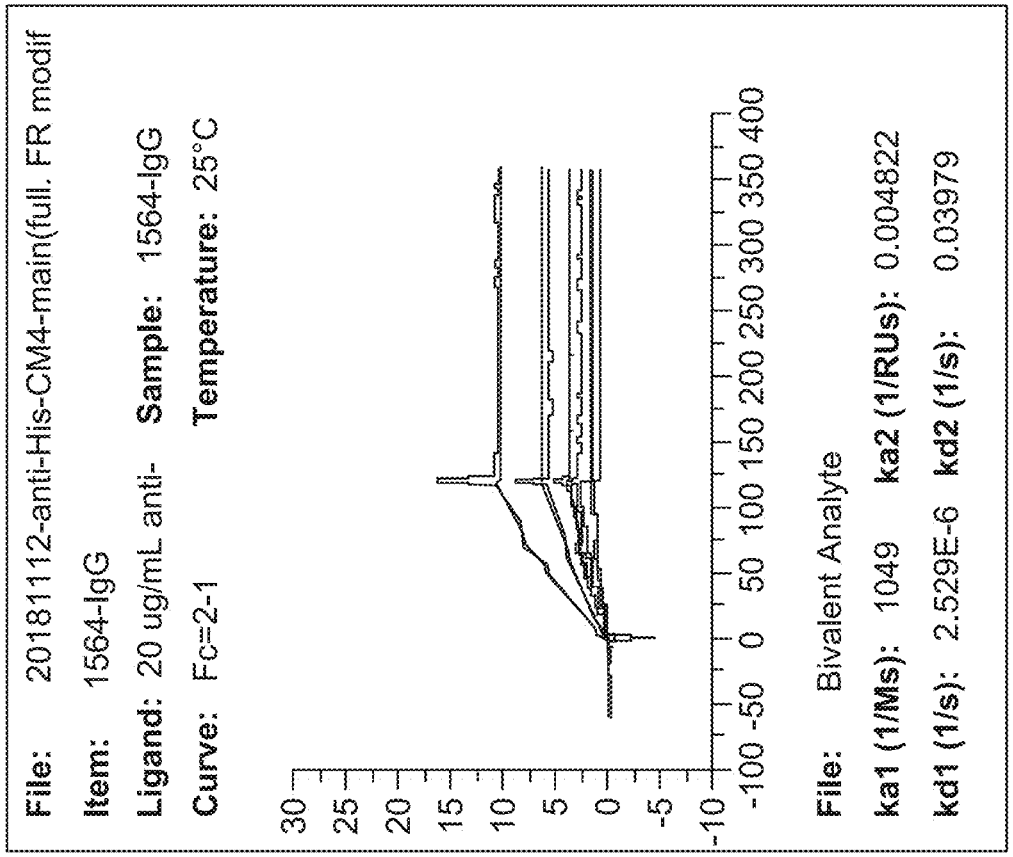
Figure 11B:
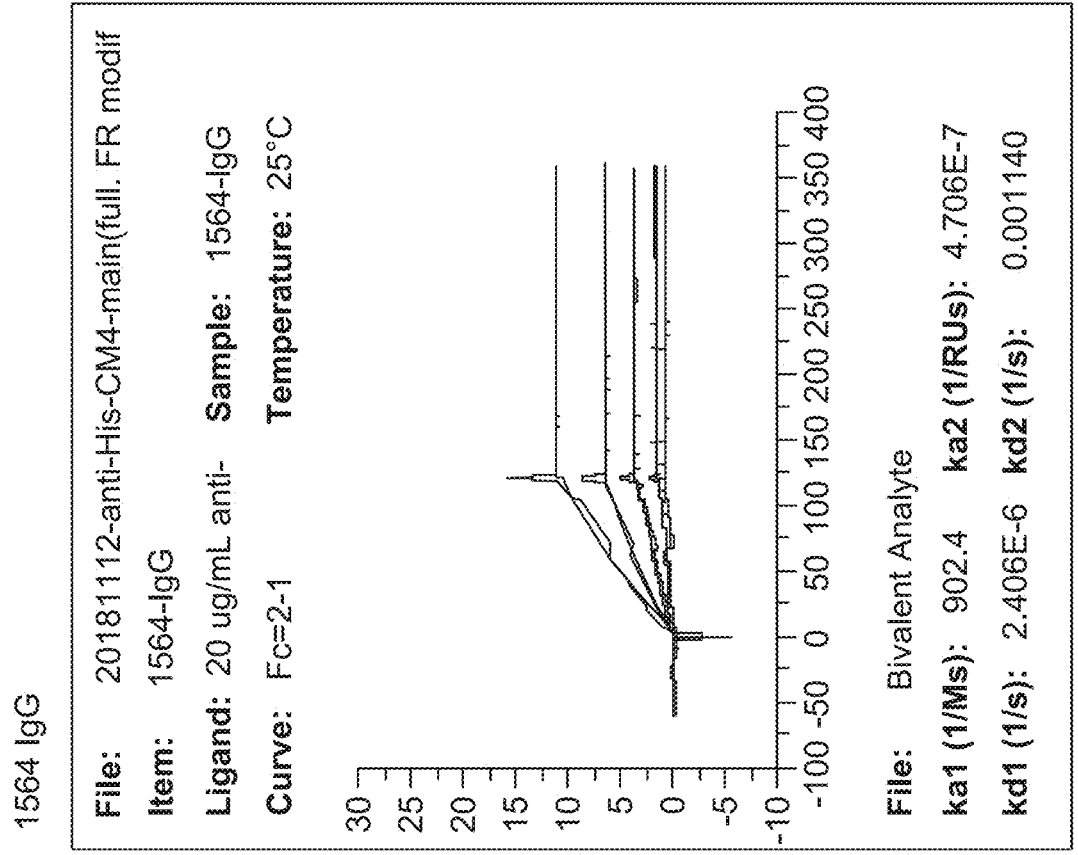

As a result of the analysis, the $K_D$ of the 1564 IgG antibody was confirmed to be $2.5305 \times 10^{-9}$ nM, and the F06 IgG antibody was confirmed to be $4.7802 \times 10^{-7}$ nM, all of which showed high binding ability to human IGF1R. The results of the analysis are shown in FIG. 11B. In particular, when the 1564 clone was produced in the form of IgG, the 1564 clone showed dissociation constant of $2.5305 \times 10^{-9}$ nM to the human IGF1R, and the 1564 clone confirmed that there was no significant change in binding affinity depending on the forms of antibodies.

Example 16. Binding Ability Analysis for Anti-IGF1R Antibody to Cell Line Expressing Human IGF1R and Brain Endothelial Cells 16-1: FACS Analysis for MCF-7

To confirm whether the minibody forms of clones 996, 1226, and 1564 prepared in Example 14-1 bind to endogenous IGF1R on the cell surface, the binding affinity analysis was performed for cell lines expressing human IGF1R and brain endothelial cells by FACS. The degree of binding to MCF-7, which is known as a breast cancer cell line to overexpress IGF1R, was tested by FACS.

Specifically, each of the three minibodies was diluted to 20 μg/ml, treated to 0.43×10E6 of the MCF-7 cell lines per sample, and reacted at 4° C. for 1 hour. After washing twice with PBS buffer, the anti-human FITC was diluted at 1:500, treated and reacted at 4° C. for 1 hour. After washing twice with PBS buffer, the binding degrees of the anti-IGF1R minibodies were measured using a FACS Calibur instrument. MCF-7 cells treated with only secondary antibodies were used as a control. The experimental results are shown in FIG. 12A.

A02, A06, A07, B01, B02, B09, B10, C04, D03, E06, F06, H04 (Gly), H04 (Val), VH2, VH5, VH7, VH9, VH16, VH32 and VH35 prepared in Example 12 and Example 14-2 were analyzed for their binding affinity to MCF-7 in the same manner as above. Clone 1564 were prepared by the method of Example 14-2 and compared as parental clones, and MCF-7 cells treated with only secondary antibodies were used as controls. The analysis results are shown in Table 21 and FIG. 12C.

According to the results of the above experiment, it was expressed as Mean Fluorescence Intensity (MFI) of the sample, and the scFv in three minibodies, the affinity variants in the bispecific antibodies and the parental clone (1564 clone) bound specifically to the endogenous IGF1R expressed on the cell surface. The result shows that the clones obtained in the above examples can be used for the intended purpose by binding to IGF1R in a form actually present in the body.

16-2: FACS Analysis for JIMT-1 and BT474

The minibodies of clones 996, 1226, and 1564 prepared in Example 14-1 in substantially the same manner, except that JIMT-1 and BT474 of breast cancer cell lines were used instead of the MCF-7 cell lines used in Example 16-1. The morphology was confirmed to bind to the endogenous IGF1R on the cell surface. The experimental results are shown in FIG. 12A.

According to the above experimental results, it was expressed as Mean Fluorescence Intensity (MFI) of the corresponding sample, and it was confirmed that scFvs in the tested three minibodies specifically bound to endogenous IGF1R on the surface of various cell lines expressing IGF1R.

16-3: FACS Analysis of Mouse Brain Endothelial Cells

It was analyzed whether the bispecific antibody form of the 1564 clone prepared by the method of Example 14-2 and the IgG form of the 1564 clone prepared by the Example 14-3 method bound to bEND.3 of the brain endothelial cell. In this regard, the group treated with only the secondary antibody and the group treated with only therapeutic antibody in IgG form (CH11F11) were used as negative controls. FACS analysis was performed in the same manner as in Examples 16-1 and 16-2. The analysis results are shown in FIG. 12B.

All tested clones showed the binding to bEND.3 except the negative controls. The results confirmed that various forms of clone 1564 specifically bound to IGF1R expressed on the surface of brain endothelial cells.

Example 17. Intracellular Internalization Analysis of Anti-IGF1R Antibody 17-1: MCF-7 Internalization Assay—1564, 996, 1226, MKJP2 (Minibody)

The example was carried out to test whether the minibody forms of the 996, 1226, 1564, and MKJP2 clones prepared in Example 14-1 were intracellularly internalized in a cell line expressing IGF1R, and the antibody introduced into the cell was passed through the RMT Pathway without undergoing degradation. In order that the anti-IGF1R antibody is used as a shuttle to improve BBB-penetrating capacity, the antibody should be internalized into brain endothelial cells constituting BBB.

The intracellular internalization of the antibodies according to the present invention was tested by using the MCF-7 cell line expressing IGF1R. Specifically, after plating 30,000 MCF-7 cell lines in an 8-well slide chamber, the cells were cultured for 1 day. The cultured cell lines were treated in each well at 4° C. for 2 hours with 5 µg/mL of minibody antibodies of the 996, 1226, 1564 and MKJP2 clones prepared in Example 14-1, washed three times with cold DMEM culture, and also treated with Alexa488-conjugated anti-human Fc antibody at 4° C. for 1 hour.

Figure 13A:
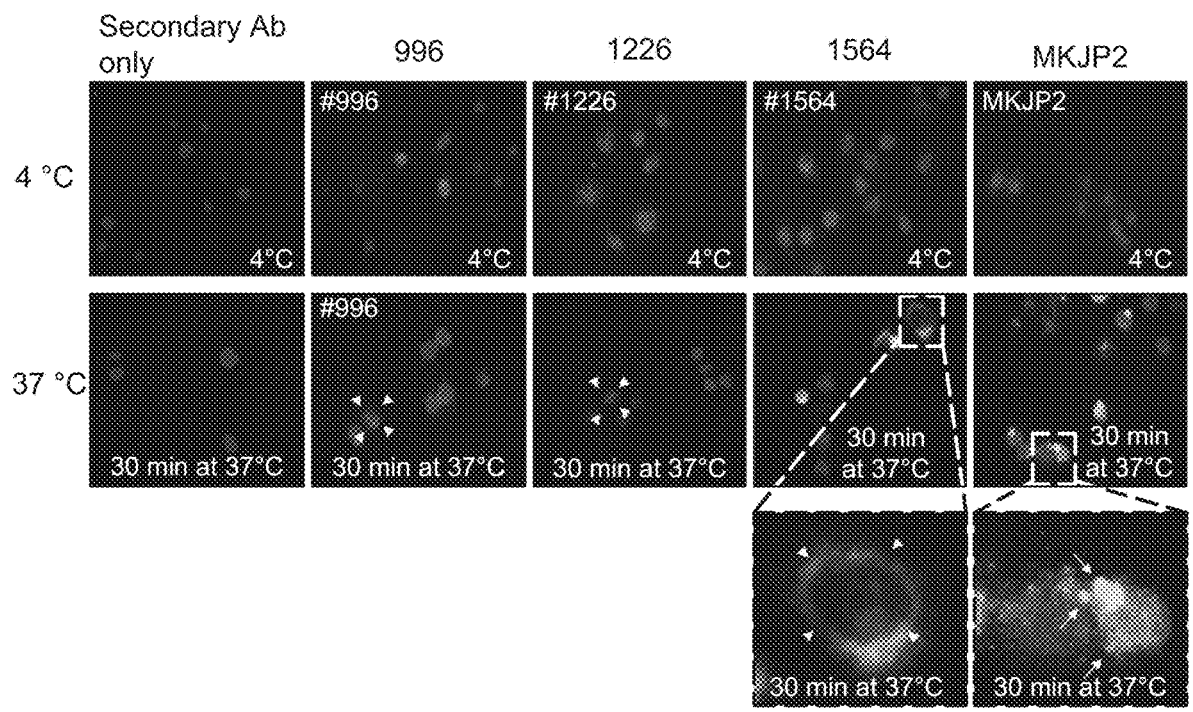
FIGS. 13A-13C show the result data associated with internalization of anti-IGF1R antibody prepared in an embodiment of the present invention into cell lines expressing IGF1R and its fate inside the cell lines.

To test the internalization of the antibody complex, the plate was transferred to a $CO_2$ incubator and incubated at 37° C. for 30 minutes. The culture was fixed by adding 100% methanol and the reaction was terminated simultaneously. After fixation, it was washed 3 times with PBS. On the fluorescence microscope, the internalization degree of the antibody was imaged in the green filter region (Alexa488). In the imaging process, the nuclei inside cells were stained using DAPI to confirm the location of each cell. The experimental results are shown in FIG. 13A.

From the experimental results, all four antibodies tested in the experiment using the MCF-7 cell line were shown to be internalized well. In particular, it was found that the internalization of MKJP2 and 1564 occurred more than other clones.

17-2: MCF-7 Internalization Assay—C04, F06, VH5, VH16, VH35, VH9, VH2, VH7 VH32

1564 variants having the change in binding capacity to IGF1R were tested or the IGF1R binding on the cell surface by FACS analysis using MCF-7 cell line expressing IGF1R. 2×10E5 MCF7 cells were treated with the bispecific antibody made by the scFv anti-IGF1R antibody at a concentration of 10 µg/mL for 30 minutes. After washing with PBS buffer containing 1% BSA, the secondary antibody bound with FITC to detect human antibodies was treated for 1 hour. After washing with PBS buffer, FACS analysis confirmed the extracellular binding and internalization of various variants with the changed binding affinity.

As shown in Table 25, the bispecific antibody including 1564 IGF1R antibody was found to have an increased internalization and an increased intensity at 37° C. than the refrigerated condition. These results suggest that the 1564 variants bind well to cells and internalize into the cells in a binding-dependent manner.

TABLE 25

| Sample | GeoMean Internalization at 37° C. |
|---|---|
| Not Treated | 1.88 |
| 2nd Ab only | 2.86 |
| hu3A9 WT | 3.4 |

TABLE 25-continued

| Sample | GeoMean Internalization at 37° C. |
|---|---|
| hu3A9x1564 WT | 7.72 |
| hu11F11 WT | 3.18 |
| hu11F11x1564 WT | 7.34 |
| hu3A9x1564 C04 | 7.23 |
| hu3A9x1564 F06 | 19.8 |
| hu11F11x1564_VH5 | 6.1 |
| hu11F11x1564_VH16 | 5.83 |
| hu11F11x1564_VH35 | 7.28 |
| hu11F11x1564_VH9 | 5.01 |
| hu11F11x1564_VH2 | 3.19 |
| hu11F11x1564_VH7 | 3.84 |
| hu11F11x1564_VH32 | 3.24 |

17-3: Internalization Analysis to Human Brain Endothelial Cells

It was tested whether the bivalent form and the monovalent form of the clone 1564 prepared in Examples 14-2 and 14-4 were internalized into primary human microvascular brain endothelial cells (HMBEC). The therapeutic antibody IgG (11F11) was used as a negative control.

Figure 13B:
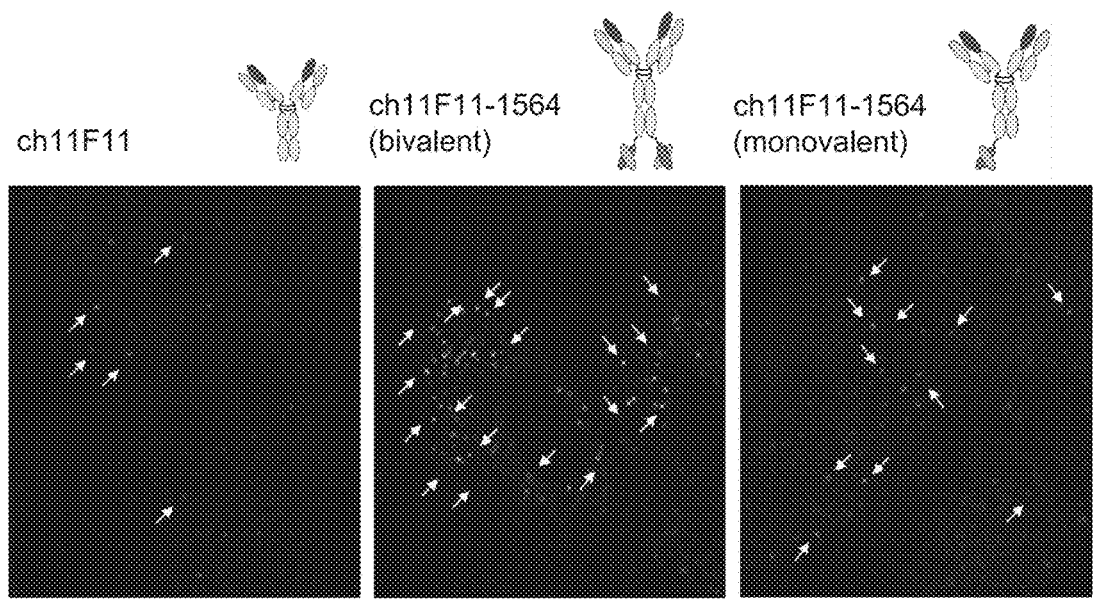

HMBEC (Cell Systems, cat #: ACBRI376) was plated in a 12-well plate at 90% confluency, and followed by test antibody After fixing with 4% paraformaldehyde and rinsing with PBS on next day, the blocking and permeabilizing were performed by using a solution containing 3% BSA and TritonX for 50 minutes. After rinsing with PBS, an antibody against human Fc (Goat anti-human antibody) was incubated for 2 hours and 30 minutes, rinsed with PBS, and treated with a secondary antibody against the corresponding primary antibody for 1 hour. After rinsing with PBS, the cells were stained by Hoechst for 10 minutes at a concentration of 1: 1000 for nuclear staining. The result was analyzed under the condition of LSM 780 NLO EC Plan-Neofluar 100×/1.3 Oil with a confocal microscope. The experimental results are shown in FIG. 13B.

The bivalent form and the monovalent form of the 1564 clone showed an increased internalization compared to the negative control therapeutic antibody (11F11). This result shows that the anti-IGF1R antibody described above can effectively internalize the therapeutic antibody into brain endothelial cells constituting BBB, as various forms of bispecific antibodies containing a therapeutic antibody linked to it, thereby increasing BBB-penetrating ability of the therapeutic antibody.

17-4: Analysis of Cellular Fate in Human Brain Endothelial Cells

If the antibody is internalized and co-localized with a lysosome-related marker in the cell, the antibody cannot pass through the BBB due to the degradation in the brain endothelial cell. In contrast, if the antibody is co-localized with an early endosome associated with exocytosis or a marker known to be associated with BBB passage, the antibody is expected to cross the BBB by receptor-mediated transcytosis that is internalized into brain endothelial cells and then exits into the brain.

After treating HMBEC in the same manner with the 1564 bivalent form among the antibodies tested in Example 17-2, it was analyzed which cellular component in these cells co-localize with these antibodies. However, each of the following antibodies was treated simultaneously with goat anti-human antibodies that detect the treated antibodies after blocking and permeabilization.

Anti-Cathepsin D: lysosomal marker
Anti-Caveolin-1: caveolin-mediated transcytosis marker (which is thought to be the main mechanism of BBB passage)
Anti-EEA1: early endosome marker The remaining parts of the methods were the same as in Example 17-2, but the secondary antibodies to the markers were treated respectively.

Figure 13C:
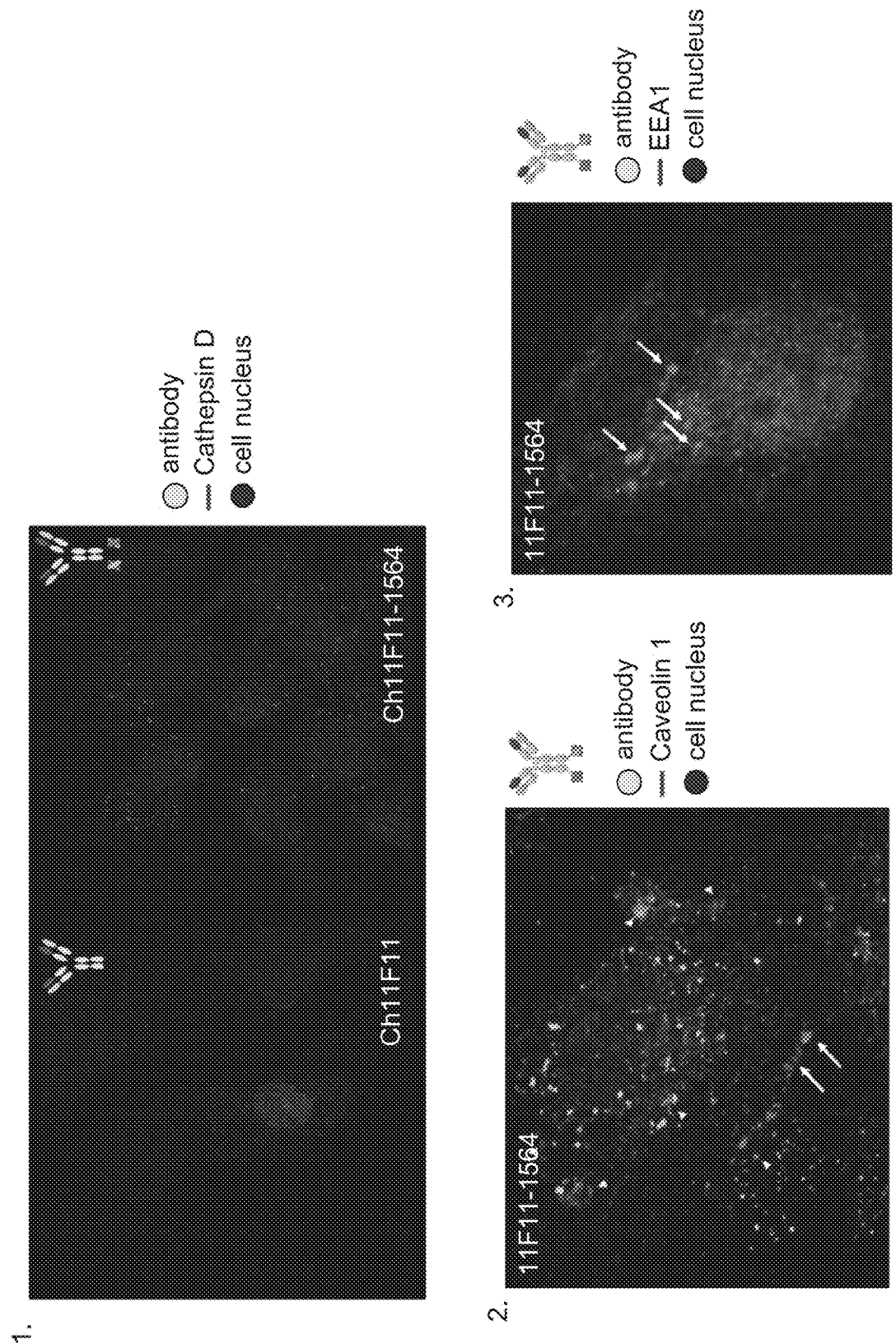

The analysis results are shown in FIG. 13C. The 1564 clone in the bispecific antibody form did not co-localize with Cathepsin D, but co-localized with caveolin-1 and EEA1 inside the cell membrane and cells. These results indicate that after the 1564 clone was internalized, it was possible to pass BBB through RMT pathway without going through the intracellular degradation mechanism.

Example 18. Analysis of the Effect of Anti-IGF1R Antibody on IGF1R Signaling 18-1: Proliferation assay of MCF-7 cell line by using IGF1R Whether the anti-IGF1R antibody according to the present invention interferes with the binding between IGF1R (IGF1 receptor) and its ligand was confirmed using cell proliferation efficacy by IGF1.

The minibody antibodies of the 996, 1226, 1564 and MKJP2 clones prepared in Example 14-1 were diluted 5 times from 400 nM, respectively, to prepare diluted samples, and then 25 μL of the diluted samples were treated with 25 μL of 20 ng/mL IGF1. The MCF-7 cell lines expressing IGF1R were cultured, and passaged by removing the medium on the day of the experiment, and 20,000 cell lines of each well (corresponding to 50 μL) were added to a 96 well plate in which IGF1 and test antibody were dispensed.

After incubating at an appropriate temperature and humidity for 3 days, 10 μL of CCK-8 reagent was treated in order to measure the degree of cell growth, and incubated in a $CO_2$ incubator for 4-5 hours. Then, it was taken out and the absorbance was measured at a wavelength of 450 nm with the spectrophotometer.

Figure 14A:
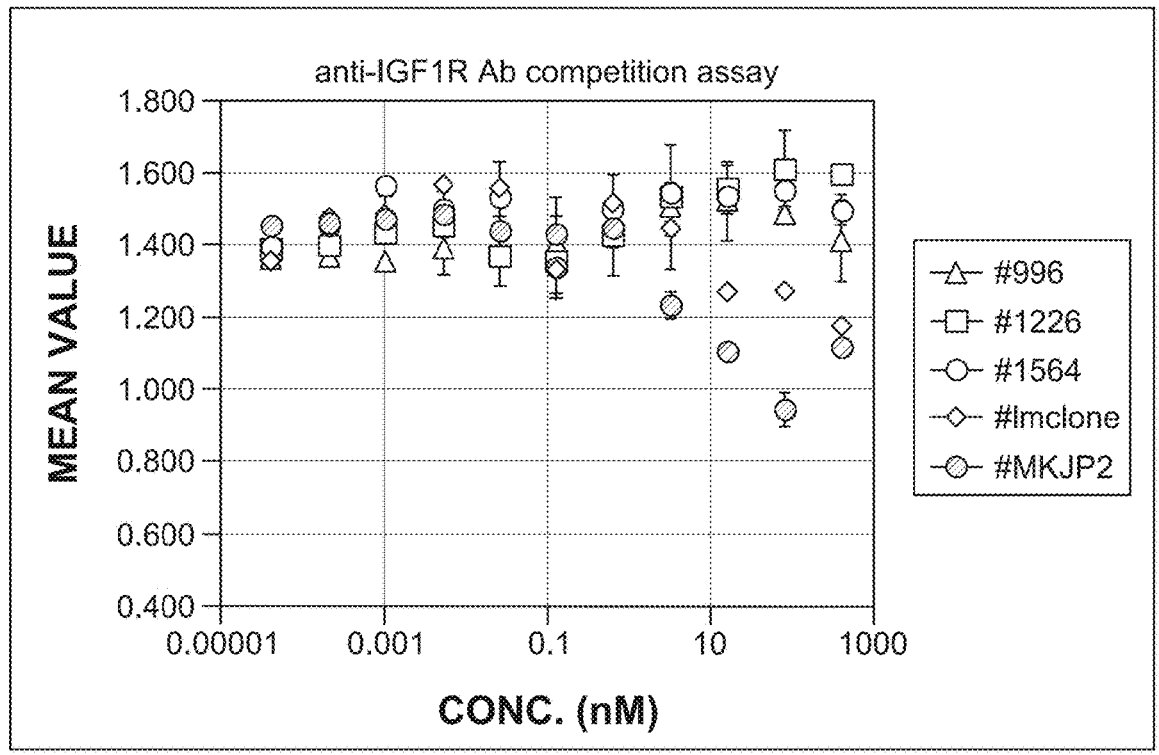
FIGS. 14A-14C are the result data showing that anti-IGF1R antibody prepared in an embodiment of the present invention does not have any effect on IGF1R signaling by IGF1R or insulin.

The experimental results are shown in FIG. 14A.

According to the experimental results, it was confirmed that the antibody according to the present invention did not inhibit the cell proliferation of MCF-7 caused by the signaling of IGF1 to IGF1R. The anti-IGF1R antibody (Im-Clone) as a control group inhibited the cell proliferation of MCF-7 by IGF1 signaling to IGF1R in the treating-concentration dependent manner. Therefore, the antibody of the present invention is an antibody having the ability to bind to IGF1R expressed in endothelial cells constituting BBB and penetrating BBB, but does not inhibit signaling by IGF1 in the body. Thus, it was confirmed that the antibody according to the present invention could be used as a BBB shuttle.

18-2: Analysis for IGF1R Inhibition of Signaling Component in MCF-7 Cell Line

When IGF1 binding to the cells expressing IGF1R delivered the signaling into cells, the anti-IGF1R antibody according to the present invention was tested to determine whether IGF1 was involved in the receptor and downstream signaling component of the signaling. That is, anti-IGF1R antibody was treated to the MCF-7 cell lines expressing IGF1R, and then total IGF1R, phosphorylated IGF1R, total Akt as downstream factors of IGF1R, and phosphorylated Akt amount in the cells were analyzed.

Figure 14B:
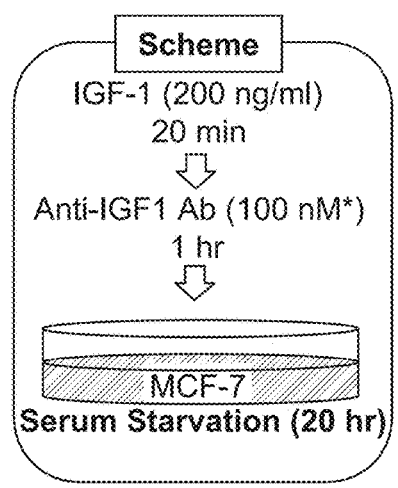
Figure 14B:
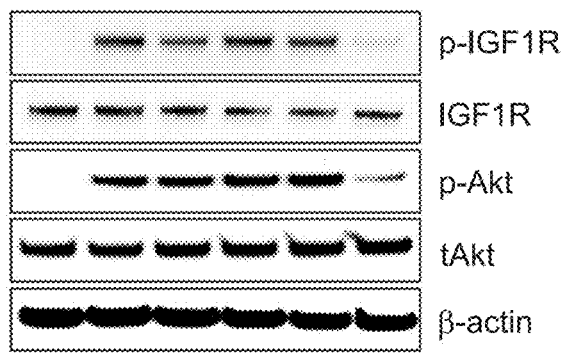

After culturing MCF-7 cells, the culture medium was changed to a serum-free culture medium at 20 hours before treatment with the anti-IGF1R antibody. The minibody antibodies of 996, 1226, 1564 and MKJP2 clones prepared in Example 4-1 were treated with 100 nM in the MCF-7 cell lines, respectively and treated with 200 ng/mL of IGF1 after 1 hour. After 20 minutes, the cells were washed with PBS and then lysed with M-PER added by protease and phosphatase inhibitor cocktail. After measuring the protein concentration using the BCA assay kit, 12.5 μg of protein was loaded onto an SDS-PAGE gel for electrophoresis, and then transferred to a PVDF membrane. The blocking was performed at room temperature with gentle shaking for 1 hour with PBST (0.1% Tween 20) containing 5% BSA, and then the primary antibody against IGF1R or Akt was treated with slow shaking at 4° C. overnight. Beta-actin antibody was used as a loading control. After washing, the secondary antibody was treated with shaking slowly at room temperature for 1 hour, and then washed. ECL solution was added, and signals were observed using ImageQuant™ LAS 4000. The experimental results are shown in FIG. 14B.

According to the experimental results, it was confirmed that the antibody according to the present invention did not affect the total IGF1R, phosphorylated IGF1R, total Akt as a downstream factor of IGF1R, and the amount of phosphorylated Akt in the cells.

18-3: Analysis for IGF1R Inhibition of Signaling Component in Mouse Brain Endothelial Cells When IGF1 binding to the cells expressing IGF1R delivered the signaling into cells, the anti-IGF1R antibody according to the present invention was tested to determine whether IGF1 was involved in the receptor and downstream signaling component of the signaling. That is, 11F11-1564 and 3A9-1564 CH11F11 and ch3A9, anti-alpha-synuclein single antibodies (described in Korean Patent Publication No. 2018-0081465) produced by the method of Example 14-2 were treated to the bEND3 cell lines expressing IGF1R, and then total IGF1R, phosphorylated IGF1R, total Akt as downstream factors of IGF1R, and phosphorylated Akt amount in the cells were analyzed.

Figure 14C:
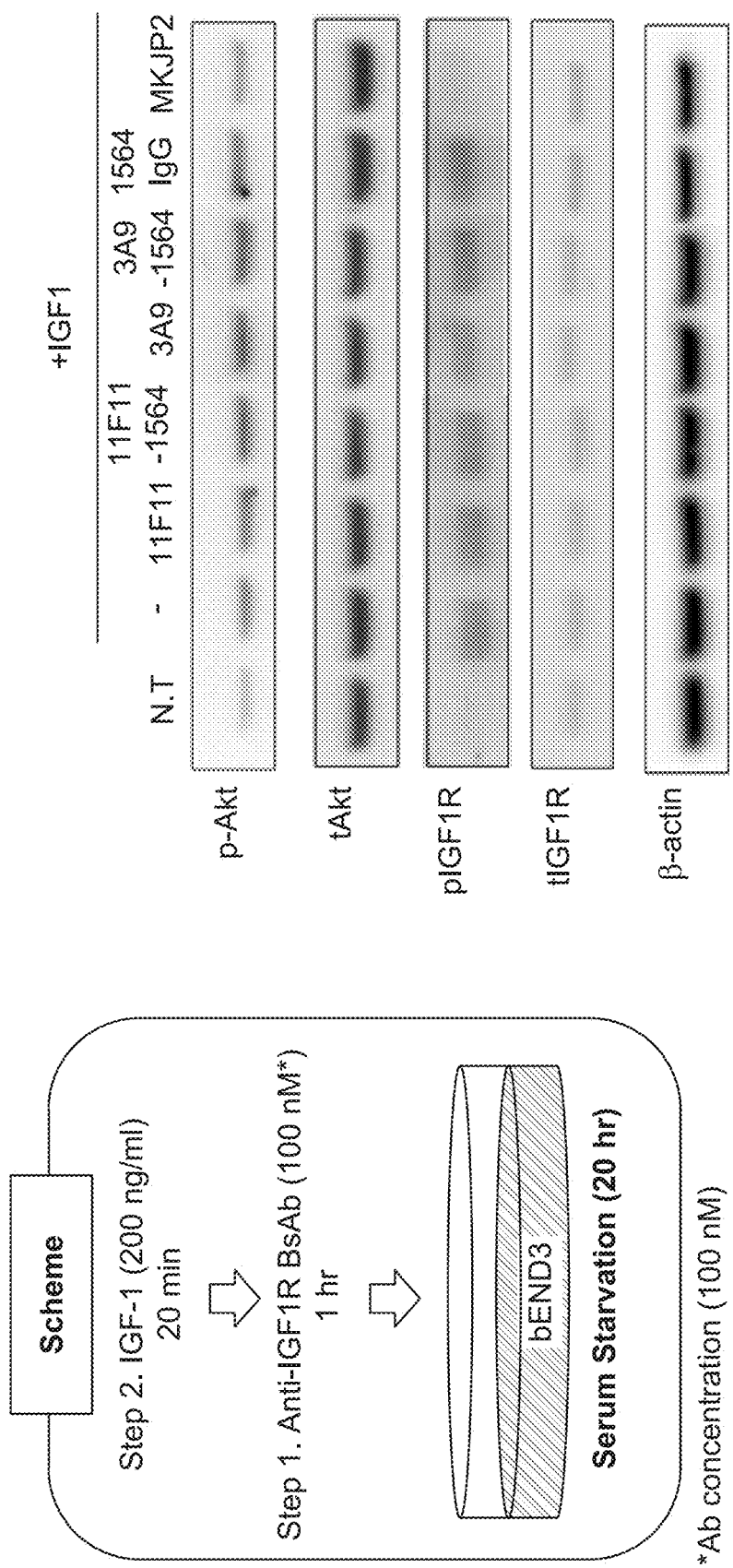

While incubating the bEND3 cells, the culture medium was changed to a serum-free culture medium at 20 hours before treatment with the anti-IGF1R antibody. The bispecific antibodies of the 1564 and MKJP2 clones of Example 14-2 were treated respectively with 100 nM in the bEND cell line and treated with 200 ng/mL of IGF1 after 1 hour. After 20 minutes, the cells were washed with PBS and then lysed with M-PER added by protease and phosphatase inhibitor cocktail. After measuring the protein concentration using the BCA assay kit, 12.5 μg of protein was loaded onto an SDS-PAGE gel for electrophoresis, and then transferred to a PVDF membrane. The blocking was performed at room temperature with gentle shaking for 1 hour with PBST (0.1% Tween 20) containing 5% BSA, and then the primary antibody against IGF1R or Akt was treated with slow shaking at 4° C. overnight. Beta-actin antibody was used as a loading control. After washing, the secondary antibody was treated with shaking slowly at room temperature for 1 hour, and then washed. ECL solution was added, and signals were observed using ImageQuant™ LAS 4000. The experimental results are shown in FIG. 14C.

According to the experimental results, it was confirmed that the antibody according to the present invention did not affect the total IGF1R, phosphorylated IGF1R, total Akt as a downstream factor of IGF1R, and the amount of phosphorylated Akt in the cells.

Example 19. Non-Toxicity Analysis of Anti-IGF1R Antibody 19-1: ADCC Analysis of IGF1R Antibody in IgG Form The anti-IGF1R antibody in IgG form according to Example 14-3 was tested to identify whether it did affect the cell death by IGF1R-dependent binding to the surface of the cells expressing IGF1R. That is, the ADCC reporter bioassay kit was used for analyzing the activation of natural killer cells (NK cells) and adverse effect on the cells expressing IGF1R, when the 1564 clone of an anti-IGF1R antibody was bound to the cell lines expressing IGF1R.

Figure 15A:
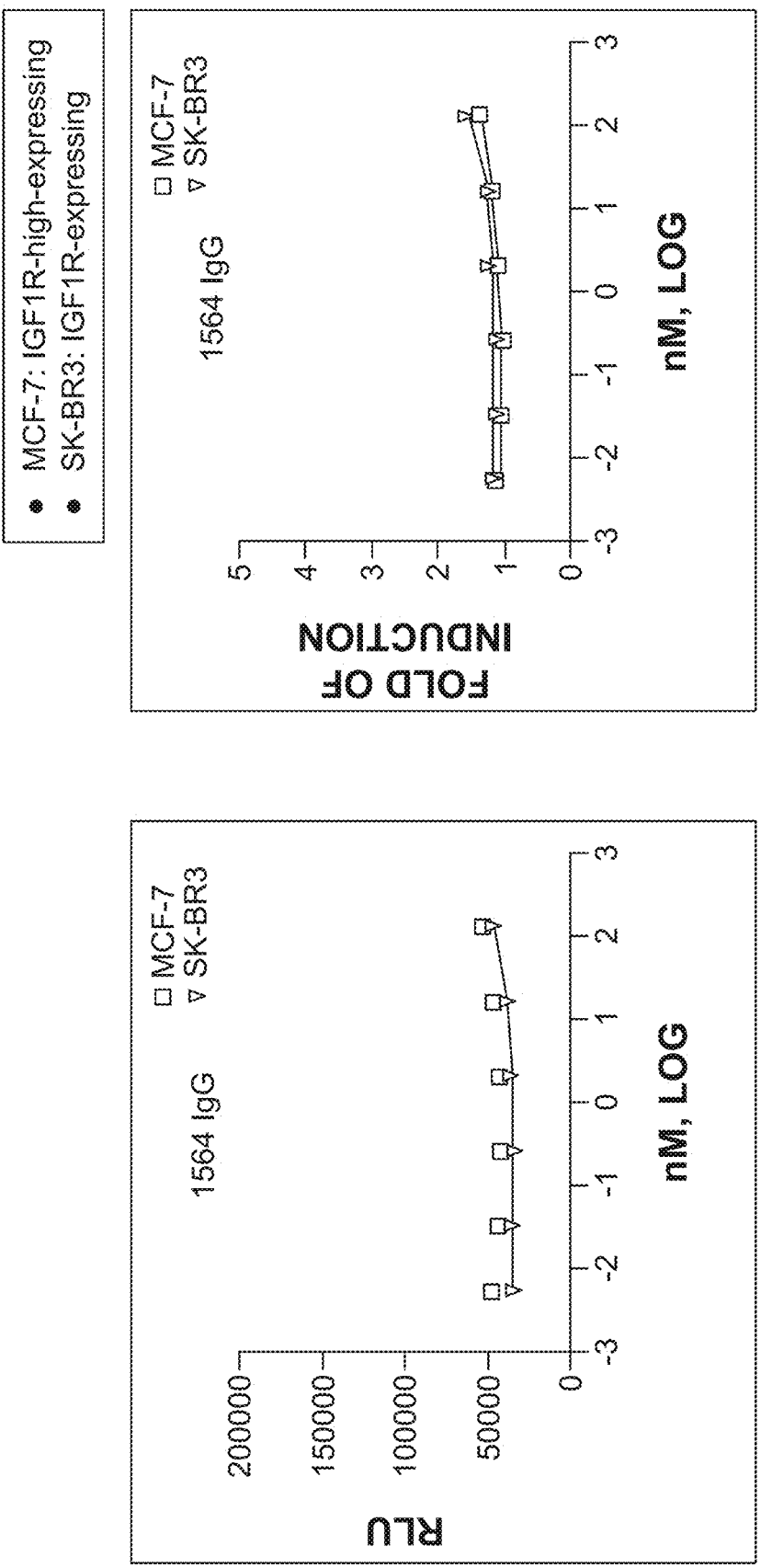
FIG. 15A is the result data showing that anti-IGF1R antibody prepared in an embodiment of the present invention does not have ADCC.

After incubating MCF-7 cells overexpressing IGF1R and SKBR3 cells expressing IGF1R at a low level, 5000 cells per well were dispensed into a 96-well plate at 20 hours before antibody treatment. The cultured cells were exchanged with RPMI/1640 medium containing 4% low IgG serum, and the clone 1564 in IgG form were diluted by 8-fold from 133.3 nM and added to each well. The stabilized ADCC effector cells were added to each well, incubated for 6 hours, and then left at room temperature for about 10 minutes. After adding by the prepared Bio-Glo luciferase assay reagent to each well, the degree of luminescence was measured with PHERAster FS BMG LABTECH equipment to analyze the degree of ADCC induction. The experimental results are shown in FIG. 15A.

According to the experimental results, it was confirmed that the antibody according to the present invention, particularly 1564 clone bound to MCF-7 cells, which was the cell lines overexpressing IGF1R, and SKBR3 cells expressed IGF1R at a low level, but did not induce ADCC by effector cells.

19-2: Analysis for the IGF1R Level in the Brain after Repetitive Administration of Anti-IGF1R Antibody The antibodies used as BBB shuttles bind to target receptors of brain endothelial cells to increase the penetrating ability of therapeutic antibodies, but should not change the corresponding receptor level. The down regulation of target receptors can affect their role in the target brain, thereby causing side effects.

It was analyzed whether the anti-IGF1R antibody of the present invention affected the IGF1R levels in the brain even after repetitive administration. According to Example 14-6, the bispecific antibody in bivalent form which the 1564 clone was linked to a therapeutic antibody for Parkinson's disease, the single therapeutic antibody for Parkinson's disease and IgG as a negative control group were repeatedly administered to Parkinson's model mice for 3 months every week, and then the IGF1R levels in the brain tissue were analyzed by Western blotting.

After the brain tissues of three mice per a group were perfused with PBS and homogenized, 10 μg of lysate were loaded on 4-12% Bis-Tris Gel, run and transferred to PVDF membrane. The remaining part of the method was performed in the same manner as in Example 19-1.

Figure 15B:
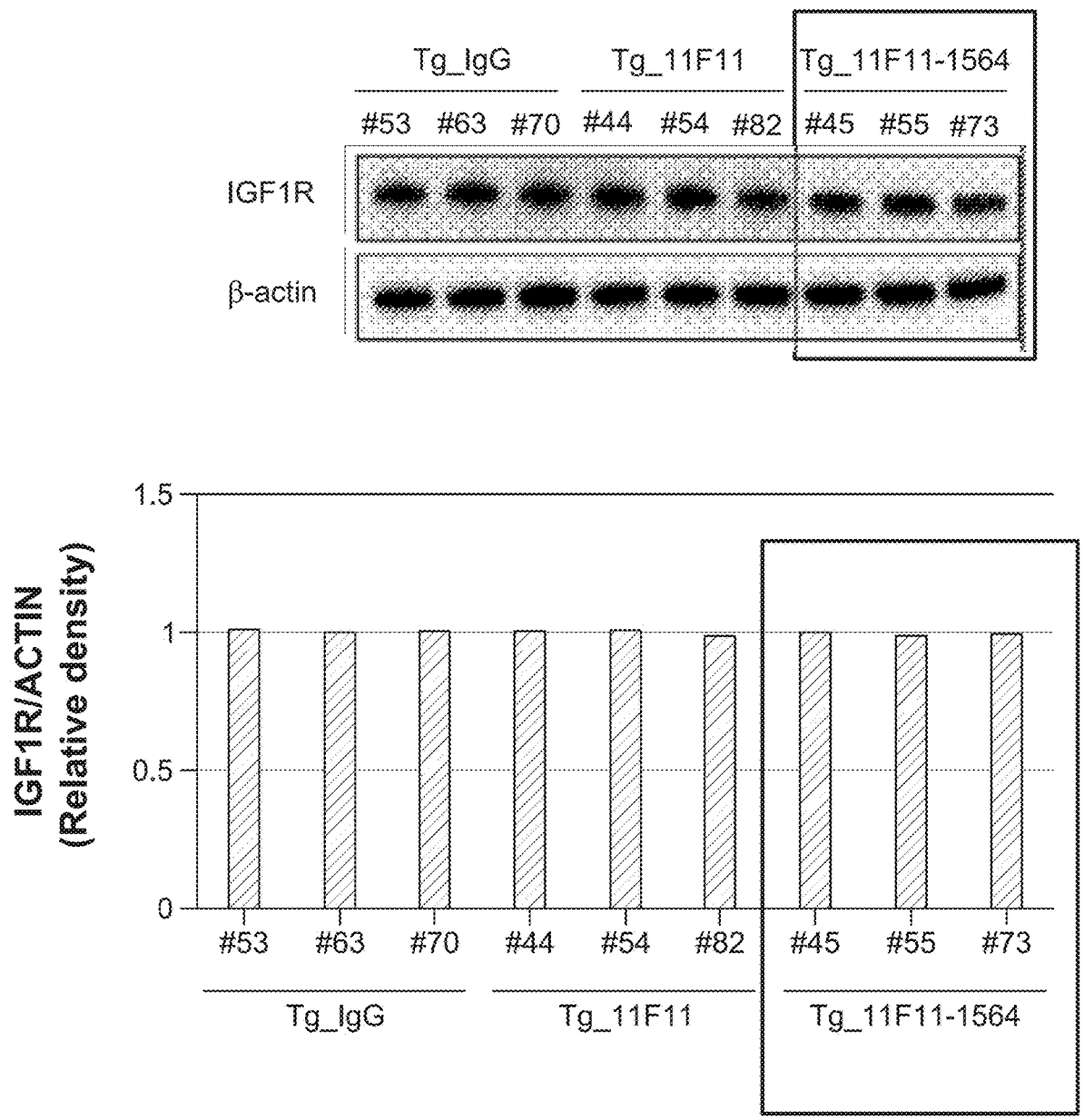
FIG. 15B is the result data showing that anti-IGF1R antibody prepared in an embodiment of the present invention does not have any effect on the IGF1R level inside brain, after being administered repetitively in IGF1R.

The experimental results are shown in FIG. 15B. The bispecific antibody composed of clone 1564 showed the IGF1R level being similar to those of the groups administered with the single therapeutic antibody for Parkinson's disease and IgG. This result shows that clone 1564 does not cause a serious change in IGF1R level of the brain even after repetitive administration, and thus, the antibody is expected to have a low side effect when used as a BBB shuttle.

19-3: Analysis for the Antibody Distribution in Brain after Administration of Anti-IGF1R Antibody The BBB shuttle binds to the receptor on the surface of the brain endothelial cell and delivers a therapeutic antibody into the brain, but the binding to the receptor on the surface of the normal cell in the brain should be at a small amount. If the BBB shuttles bind to the normal cells expressing the antigen in the brain at a large amount, the therapeutic antibody bound to the shuttle will reach the disease target at a small amount.

Figure 15C:
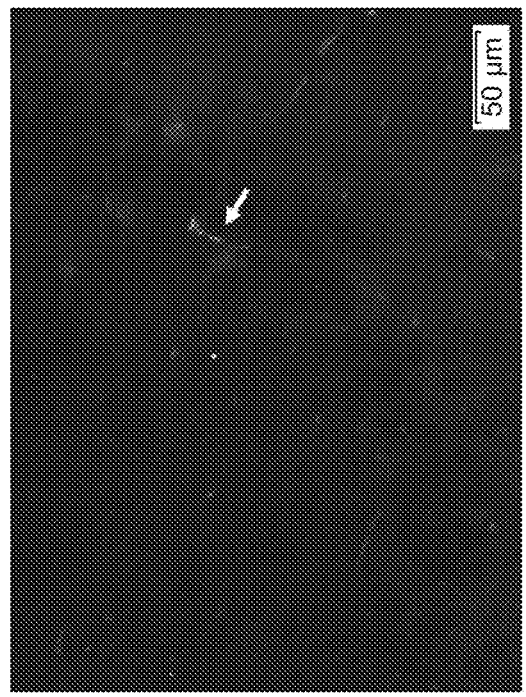
FIG. 15C shows the microscopic picture showing that anti-IGF1R antibody prepared in an embodiment of the present invention specifically binds to the brain endothelial cell without binding to the normal neuron inside brain.
Figure 15C:
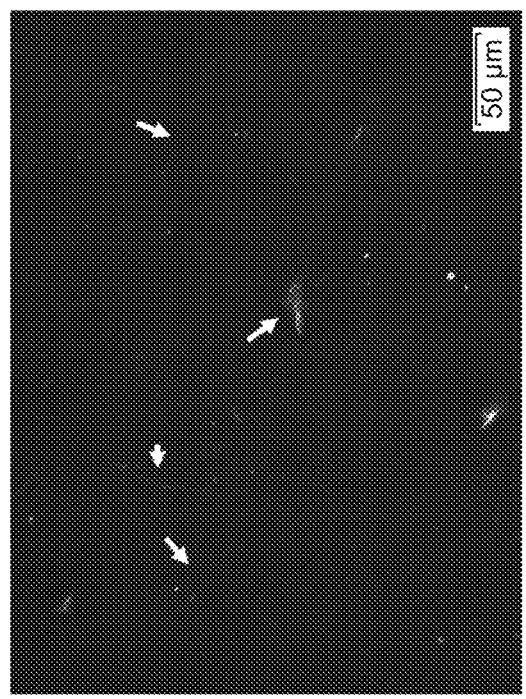
Figure 15C:
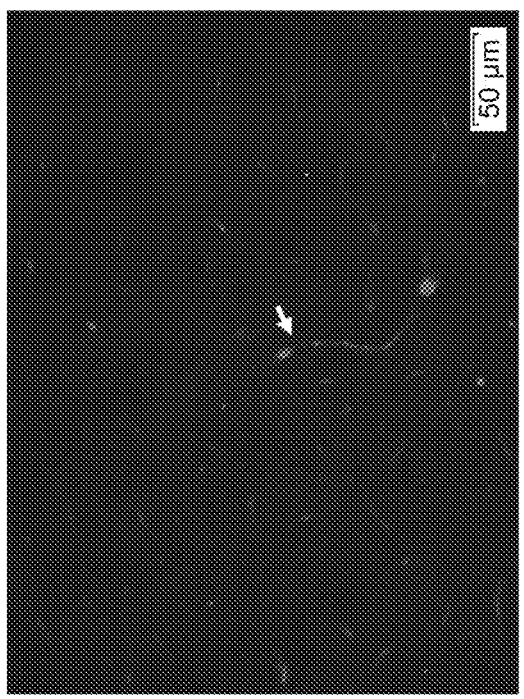
Figure 15C:
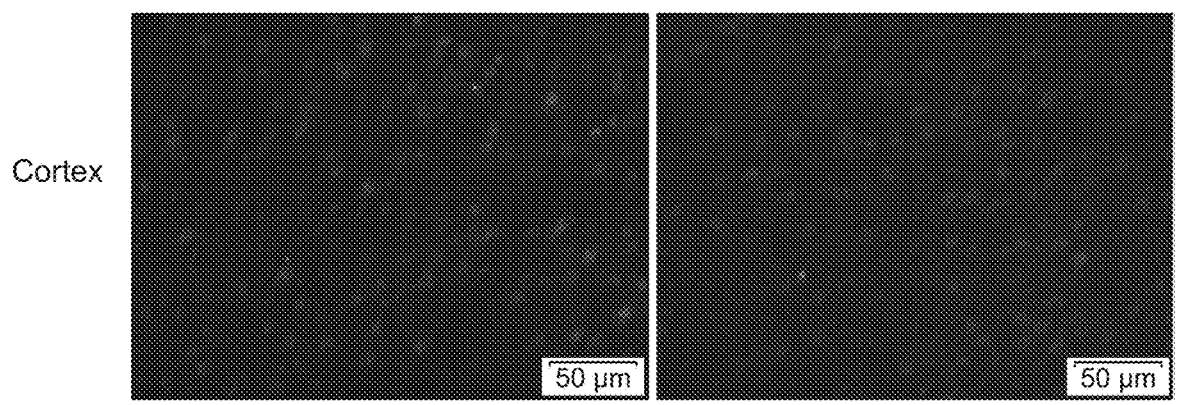

In order to analyze the distribution in brain of the anti-IGF1R antibody of the present invention, the distribution of the anti-IGF1R antibody was analyzed by immunostaining in the brain of an in vivo experimental animal performed in Example 21-2. SD rats administered with the bivalent form of the 1564 clone were perfused with physiological saline according to the transcardiac perfusion. The left hemisphere was fixed in 10% neutral-buffered formalin for 24 hours. The brain was rinsed with 1×PBS and frozen for 24 hours in a solution containing 30% sucrose. The brain was frozen in the OCT and stored at −80° C. until section. The sections were performed with a thickness of 25 m in the coronal direction and collected in 1×PBS containing 0.1% sodium azide in a 24-well Petri dish. The tissues were blocked and permeabilized by incubation with Dako serum free protein block (X0909, DAKO) containing 0.3% Tween-20 in free floating mode at room temperature for 1 hour. The primary antibody was treated with a biotinylated human Fc antibody (BA3080, Vector Labs) in a ratio of 1:50 and incubated overnight at 4° C. After washing three times with TBS, the antibody against endothelial cells was treated with RECA-1 (ab9774, AbCam) at a ratio of 1:2000 or neuron antibody NeuN (MAB377, Millipore) at a ratio of 1:250 for 2 hours. After washing, Alexa488 was bound and the secondary antibody for each antibody was treated for 45 minutes. After washing, the sections were placed on a glass slide, and the nuclei were stained by adding ProLong Gold containing Dapi or Dako fluorescent mounting media containing Hoechst 33258. In the confocal microscope, the cerebral cortex and hippocampus were analyzed at a suitable fluorescence wavelength. The analysis results are shown in FIG. 15C.

The results showed that the bispecific antibody bound by 1564 clone did not bind to the normal neurons, but specifically bound to the brain endothelial cells. Therefore, the anti-IGF1R antibody of the present invention is expected to have few side effects by increasing only the BBB-penetrating ability of the therapeutic antibody without binding to normal cells in the brain, and bring about an improvement in the therapeutic efficacy of the therapeutic antibody.

Example 20. Analysis for In Vitro BBB-Penetrating Ability of Anti-IGF1R Antibody 20-1. Analysis for BBB-Penetrating Ability of a Bivalent Antibody in BBB Model Derived from Sv-ARBEC The antibodies from Examples 11 and 12 were used for preparing the bispecific antibody in Example 14-2 and then tested for in vitro BBB-penetrating ability of the bispecific antibody in BBB model composed of Sv-ARBEC. Sv-ARBEC was plated as a single layer on a permeable membrane and the integrity of the BBB system was evaluated in advance based on the resistance (TEER) and sucrose passage degree of the BBB system. At this time, sv-ARBEC was treated with rat astrocyte culture medium (RAS-CM), which was known to help the integrity of the system. After the bivalent bispecific antibodies of the test antibodies 1564, 48G5, 54H4, 60H6, and B11 were treated on the membrane, the amounts of antibodies in the bottom chamber were analyzed by mass spectrometer after 90 minutes. For the mass spectrometry, the signature peptides from each antibody Fc and scFv were analyzed and then used. At this time, a therapeutic antibody for Parkinson's disease alone (11F11) and a bispecific antibody in which the scFv form of biosimilar to Herceptin™ was linked to the therapeutic antibody were used as negative controls. The calibration limit of the system was determined by passing A20.1 antibody (National research council production) which was not known to penetrate BBB. The values obtained in the mass spectrometer were input into the formulas known in the prior literature, to produce Papp value, which represented the degree of BBB-penetrating ability in vitro.

Figure 16A:
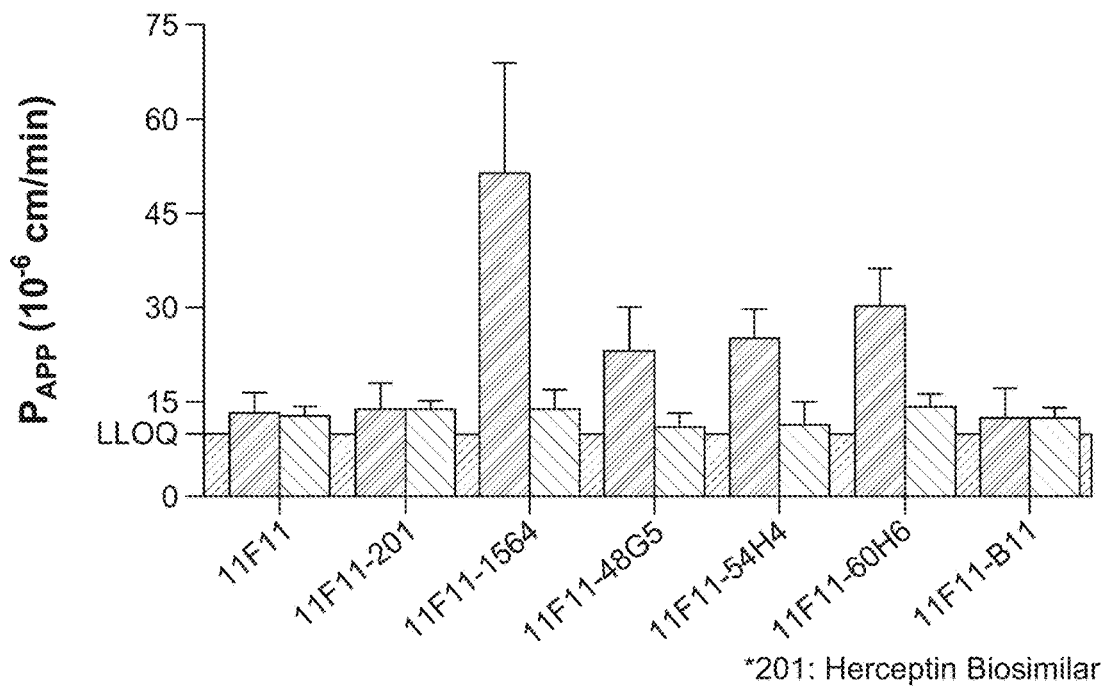
FIGS. 16A-16C are the result data showing that the bispecific antibody including anti-IGF1R antibody and a therapeutic antibody can penetrate into BBB system more efficiently than the therapeutic antibody.

The analysis results are shown in FIG. 16A. The tested antibodies except for B11 showed higher in vitro BBB-penetrating ability than the negative control. In particular, clone 1564 showed higher BBB-penetrating ability than other clones. This shows that 1564, 48G5, 54H4, 60H6 clones and the bispecific antibody linked to 1564, 48G5, 54H4, 60H6 clones can have a higher in vivo BBB-penetrating ability than a single antibody.

Figure 16B:
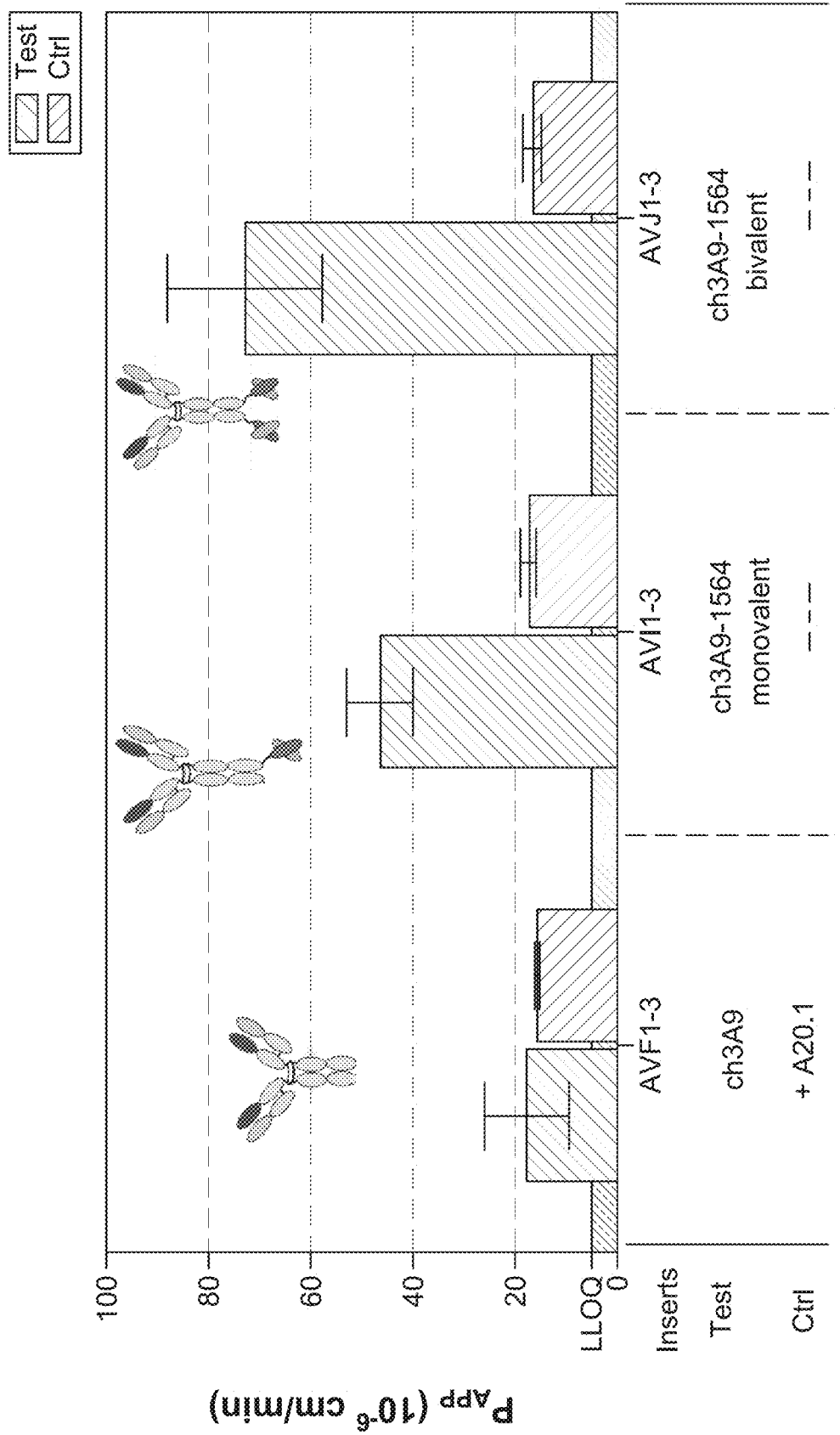

20-2. Analysis for BBB-Penetrating Ability of a Monovalent Antibody in BBB Model Derived from Sv-ARBEC In the same model as Example 20-1, in vitro BBB-penetrating abilities of the monovalent antibodies prepared according to Example 14-4 and bivalent antibodies prepared according to Example 14-2 were analyzed. The bivalent antibody and the monovalent antibody prepared by 1564 clone, and the therapeutic antibody for Parkinson's disease (3A9) as a negative control were passed through sv-ARBEC BBB system, and then the amount of the penetrating antibodies were analyzed. The analysis results are shown in FIG. 16B.

The bivalent form and monovalent form of the 1564 clone showed higher in vitro BBB penetrating abilities than the single antibody of 3A9, and particularly, the BBB-penetrating ability of the bivalent form was higher than the monovalent form. This shows that 1564 clone can enhance in vitro BBB-penetrating ability of therapeutic antibodies linked to it in various forms.

20-3. Analysis for BBB-Penetrating Ability of an Anti-IGF1R Antibody in a BBB Model Derived from Human IPSC The BBB model derived from human stem cells shows higher resistance (TEER) than the BBB system derived from rat or mouse cells and expresses all of the various markers identified in BBB. Therefore, the BBB tightness of the human stem cell-derived model is higher than that of the animal cell-derived BBB, and the model reproduces human BBB well.

The vectors such as oriP/EBNA1 episomal vectors encoding OCT4, SOX2, c-Myc, KLF4, NANOG and LIN28 were introduced into the cells derived from human amniotic fluid (AF-iPSC) and reprogrammed to iPSC. The produced colonies were treated with KO DMEM/F12, KOSR, glutamax, NEAA, and beta-mercaptoethanol to produce the endothelial cells in pre-differentiation state, and then treated with serum-free endothelial differentiation medium, 1% PDS, and 20 ng/mL bFGF to differentiate into the brain endothelial cells. The acquisition of amniotic fluid cells and the establishment of BBB system using the cells were performed by the National Research Council. After confirming the integrity of the system with the resistance value and the sucrose passage value, the anti-IGF1R antibody was analyzed for its BBB-penetrating ability in the form of a bispecific antibody combined a therapeutic antibody for Parkinson's disease with the scFv form of the anti-IGF1R antibody. The test antibodies were the bivalent form of 1564 clone, the monovalent form of 1564 clone, the bivalent form of F06 clone, and the bivalent form of C04 clone. 11F11 as a therapeutic antibody for Parkinson's disease was used as a negative control. The antibodies that passed through the BBB system were analyzed in the same manner as in Example 20-1.

Figure 16C:
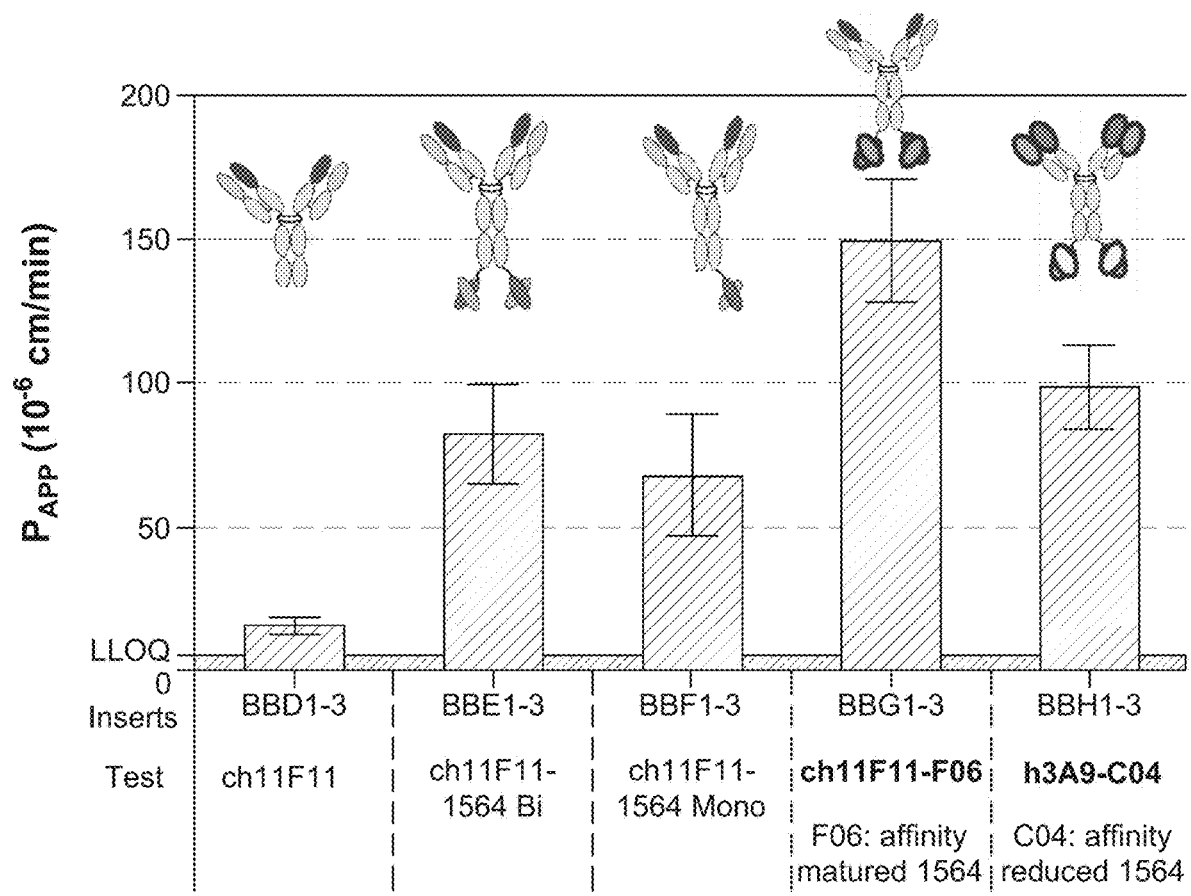

The analysis results are shown in FIG. 16C. All test clones showed high BBB-penetrating ability compared to the negative control group. In particular, F06 bivalent and C04 bivalent represented up to 15 times higher BBB-penetrating ability than the single antibody. The results show that the anti-IGF1R antibodies of the present invention efficiently pass the human-derived BBB system as compared to the single antibody.

Example 21. Analysis for In Vivo BBB-Penetrating Ability of Anti-IGF1R Antibody (Co-Localization Assay)

21-1. Minibody Co-Localization with Brain Vessel

The following experiment was conducted to confirm whether the anti-IGF1R antibodies of the present invention were distributed along the brain vasculature in vivo.

Specifically, PBS buffer or 10 mg/kg of IgG control, and the minibody antibodies of clones 996, 1226, and 1564 prepared in Example 14-1 were administered to the tail vein of a 6-8 week old BALB/c male mouse, respectively. After 4 hours, the mouse brain was intracardially perfused with a sufficient amount of 0.9% NaCl solution and 4% paraformaldehyde. The fixed brain was extracted and sectioned at 20 m, and co-staining was performed with anti-mouse CD31 as a vascular marker, and anti-human Fc antibodies, to confirm co-localization of the brain vessels and the tested IGF1R. A secondary antibody conjugated with Alexa 488 for CD31, and the secondary antibody conjugated with Alexa 594 for human Fc were used for imaging CD31 and human Fc under a fluorescence microscope.

Figure 17A:
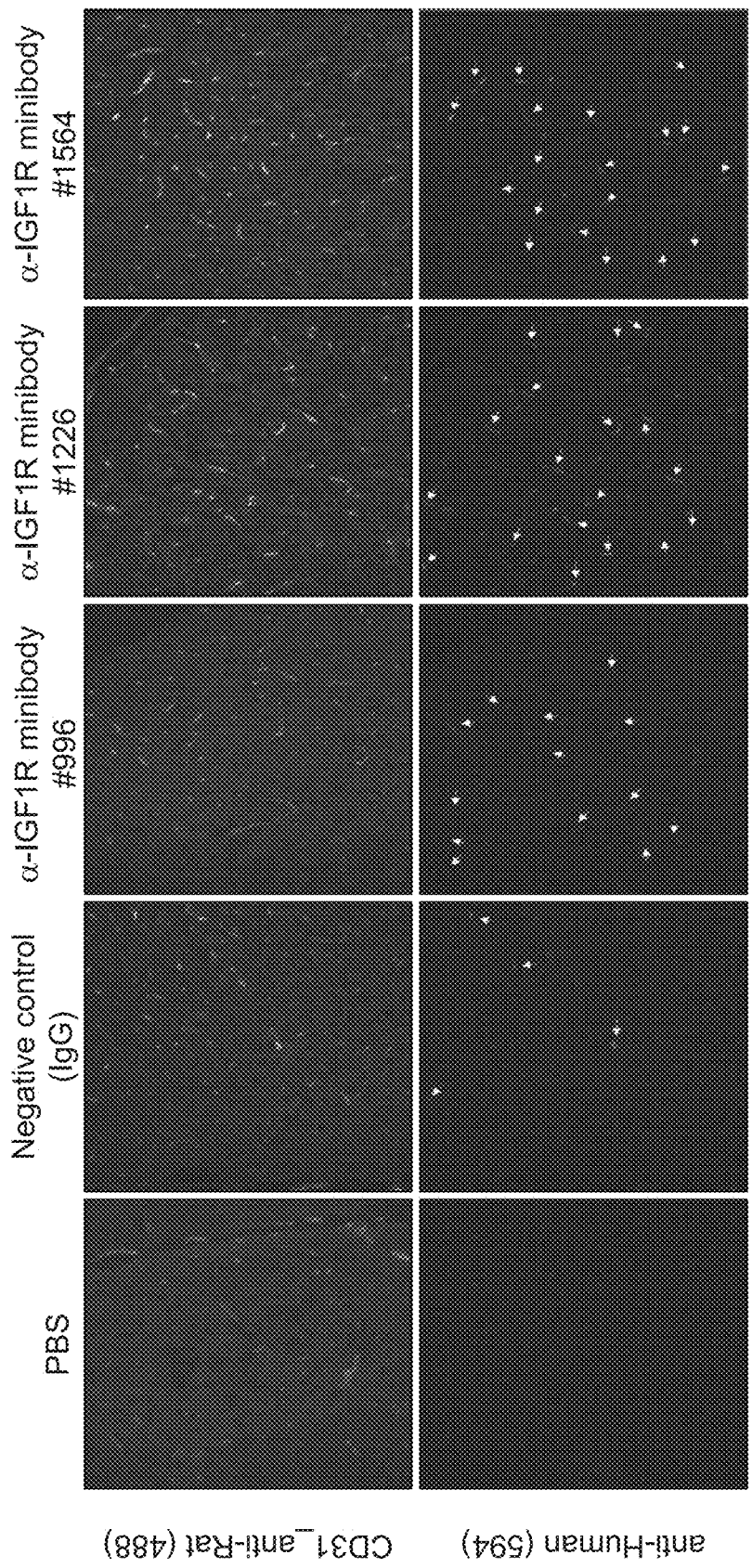
FIGS. 17A-17F are the result data showing that the anti-IGF1R antibody and the bispecific antibody including anti-IGF1R antibody and a therapeutic antibody are distributed more in brain and CSF than the therapeutic antibody alone, when they are administered into rat once.

The experimental results are shown in FIG. 17A.

According to the experimental results, it was confirmed that the non-blocking antibodies for the ligand binding according to the present invention had an excellent BBB-penetrating ability. As a result of the staining the brain tissues with vascular markers (anti-CD31, green) and human antibodies (anti-human Fc, red) according to the method of analyzing the antibody co-localization degree with cerebral blood vessels by immunostaining (Neuron (2016) Yu-Zuchero et al.), the non-blocking antibodies for the ligand binding according to the present invention showed a higher degree of co-localization than the IgG control group.

21-2. Analysis for In Vivo BBB-Penetrating Ability of Bispecific Antibody

The anti-IGF1R antibody of the present invention was attempted to confirm in vivo BBB-penetrating ability in normal rats. PBS buffer or 10 mg/kg of IgG control, and therapeutic antibody for Parkinson's disease (11F11) or the bivalent bispecific antibody (11F11-1564) containing 1564 clone linked to the therapeutic antibody were administered to the tail vein of SD rats, respectively. At 24 hours, the amounts of antibodies in CSF and brain were analyzed by the mass spectrometry. The mass spectrometry was performed as the same method as Example 20-1.

The bispecific antibody to which the 1564 clone was bound showed higher CSF and brain penetration ability than the therapeutic antibody to which the anti-IGF1R antibody was not bound, and the efficacy was confirmed at both 10 and 30 mg/kg doses. The bispecific antibody showed the brain-penetrating ability up to about 4.5 times higher than the single antibody at 30 mg/kg dose.

Clone 1564 were prepared in bivalent form and monovalent form according to Examples 14-2 and 14-4, and then administered at 30 mg/kg or 60 mg/kg in the same manner as described above, and the amounts of antibodies in CSF and brain were analyzed after 24 hours. The two types of bispecific antibodies bound to 1564 clone showed higher CSF and brain penetration ability than single antibodies. In particular, the bivalent form showed a higher BBB penetration ability than the monovalent form, which was increased brain-penetrating ability up to 5-fold.

Figure 17B:
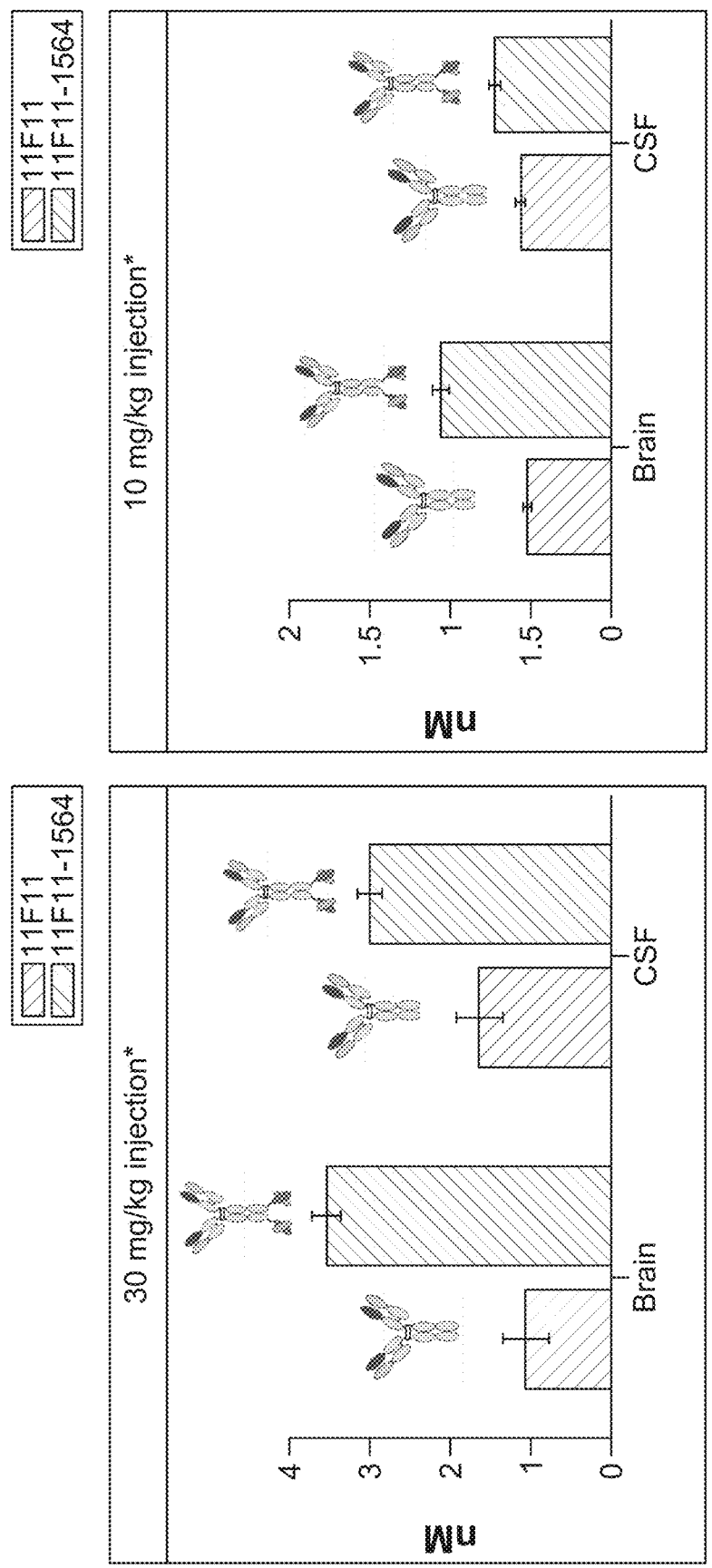
Figure 17C:
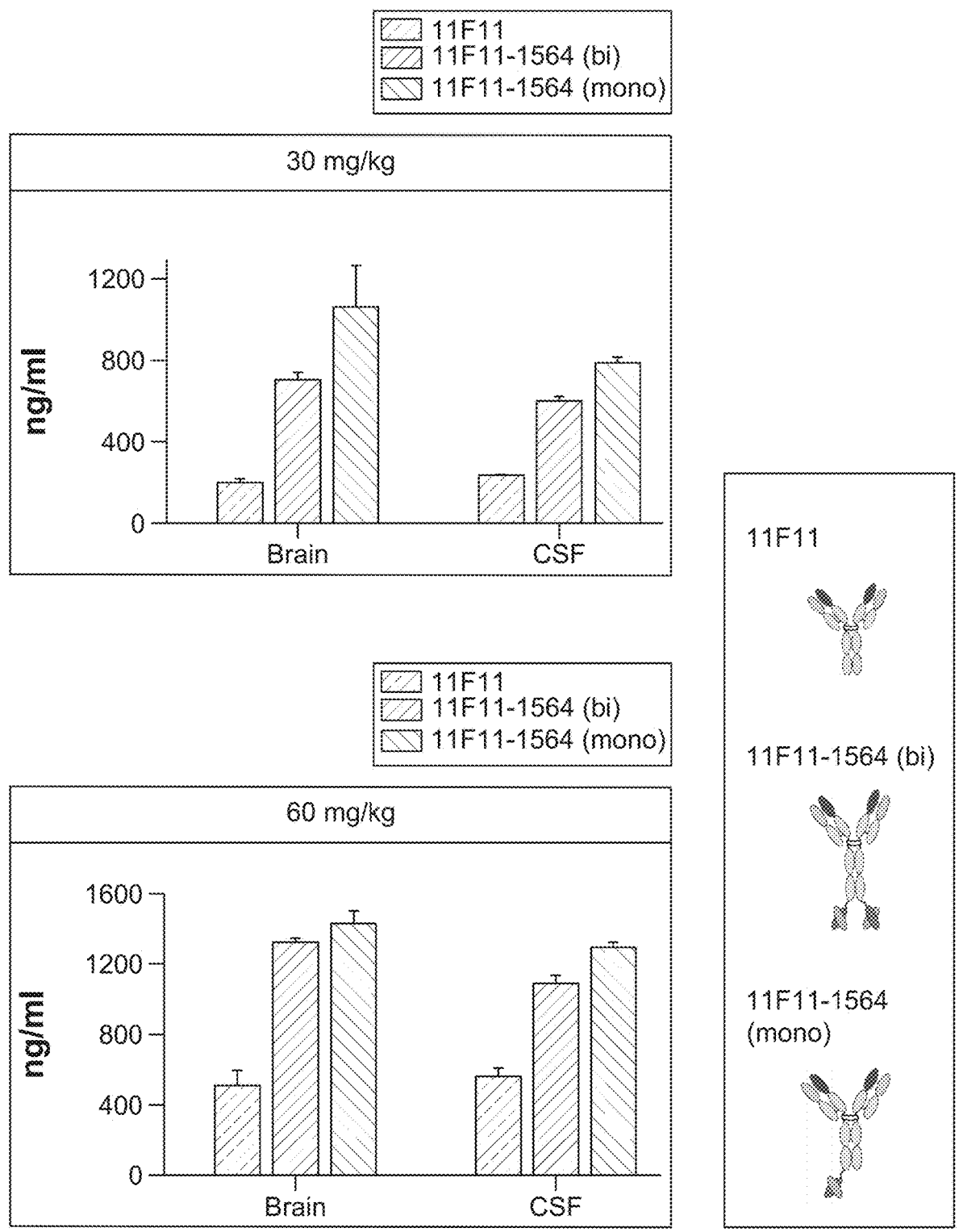

The results of FIG. 17B show that 1564 clone improves the BBB-penetrating ability of the therapeutic antibody in the body even when bound to the therapeutic antibody in various forms.

The affinity variants of 1564 clone prepared according to Example 2 were expected to increase PK in a serum compared to the parental clone. Therefore, it was expected that the BBB-penetrating ability would be improved by remaining in the serum for a long time and continuously maintaining the BBB influx. After the affinity variants produced in bivalent form according to Example 14-2 or monovalent form according to Example 4-4 was administered intravenously to SD rats at 30 mg/kg, the blood was collected from the eye vein gun at 0, 24, and 48 hours. The tested antibodies were divided into two experiments according to the backbone of the therapeutic antibody. The bispecific antibodies of the corresponding variants used in the experiment are shown in Table 26 below.

TABLE 26

The bispecific antibodies used for analysis of in vivo BBB-penetrating ability

| Chimeric backbone clones | Humanized Backbone clones |
|---|---|
| Ch11f11-1564 bivalent | Hu11f11(ver. 2)-1564 bivalent |
| Ch11f11-1564 monovalent | Hu11f11(ver. 2)-VH5 bivalent |
| Ch11f11-C04 monovalent | Hu11f11(ver. 2)-VH16 bivalent |
| Ch11f11-F06 bivalent | Hu11f11(ver. 2)-VH35 bivalent |
| Ch11f11-F0f monovalent | Hu11f11(ver. 2)-VH9 bivalent |
| ** | Hu11f11(ver. 2)-VH2 bivalent |
| ** | Hu11f11(ver. 2)-VH7 bivalent |
| ** | Hu11f11(ver. 2)-VH32 bivalent |

Figure 17D:
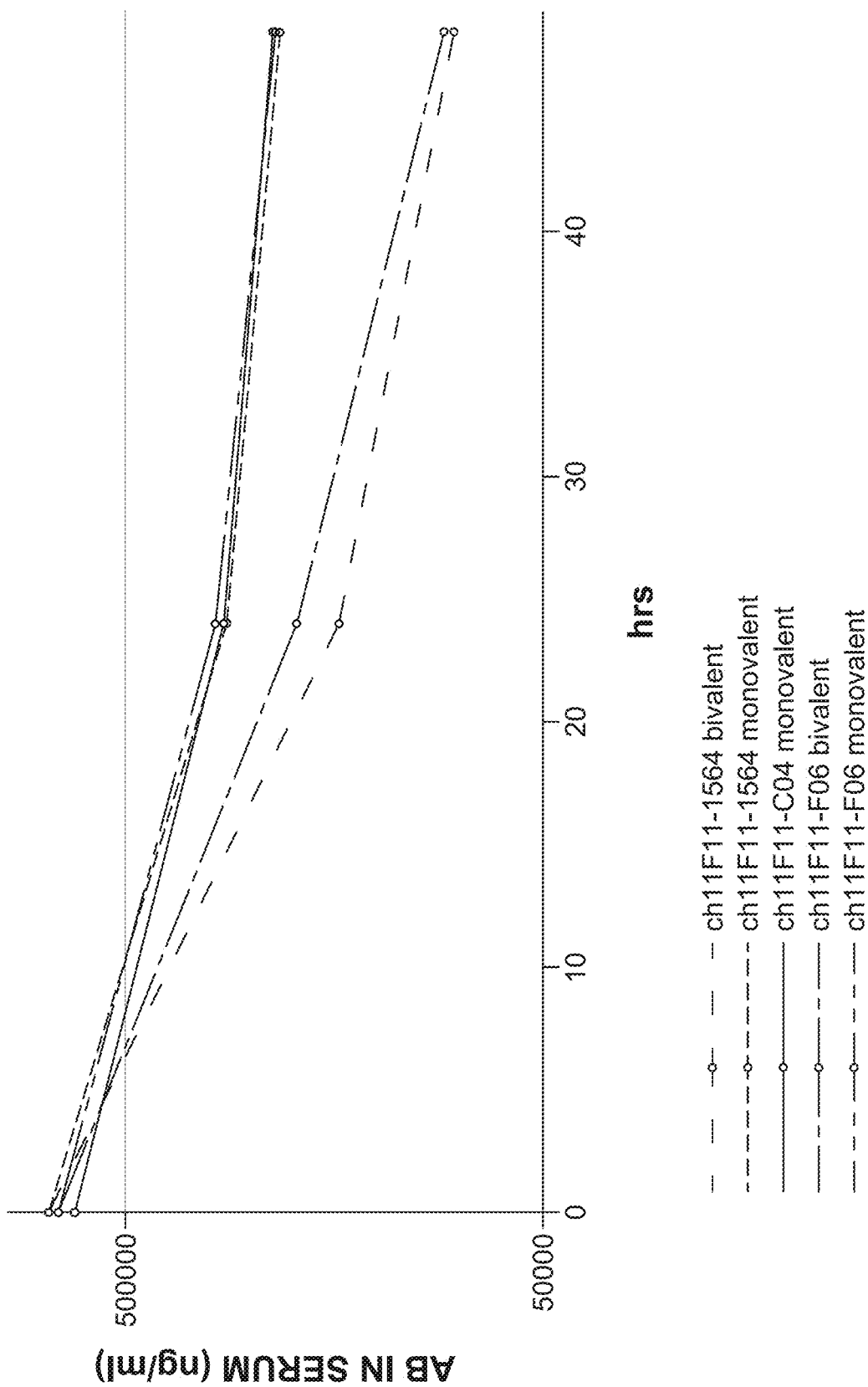
Figure 17E:
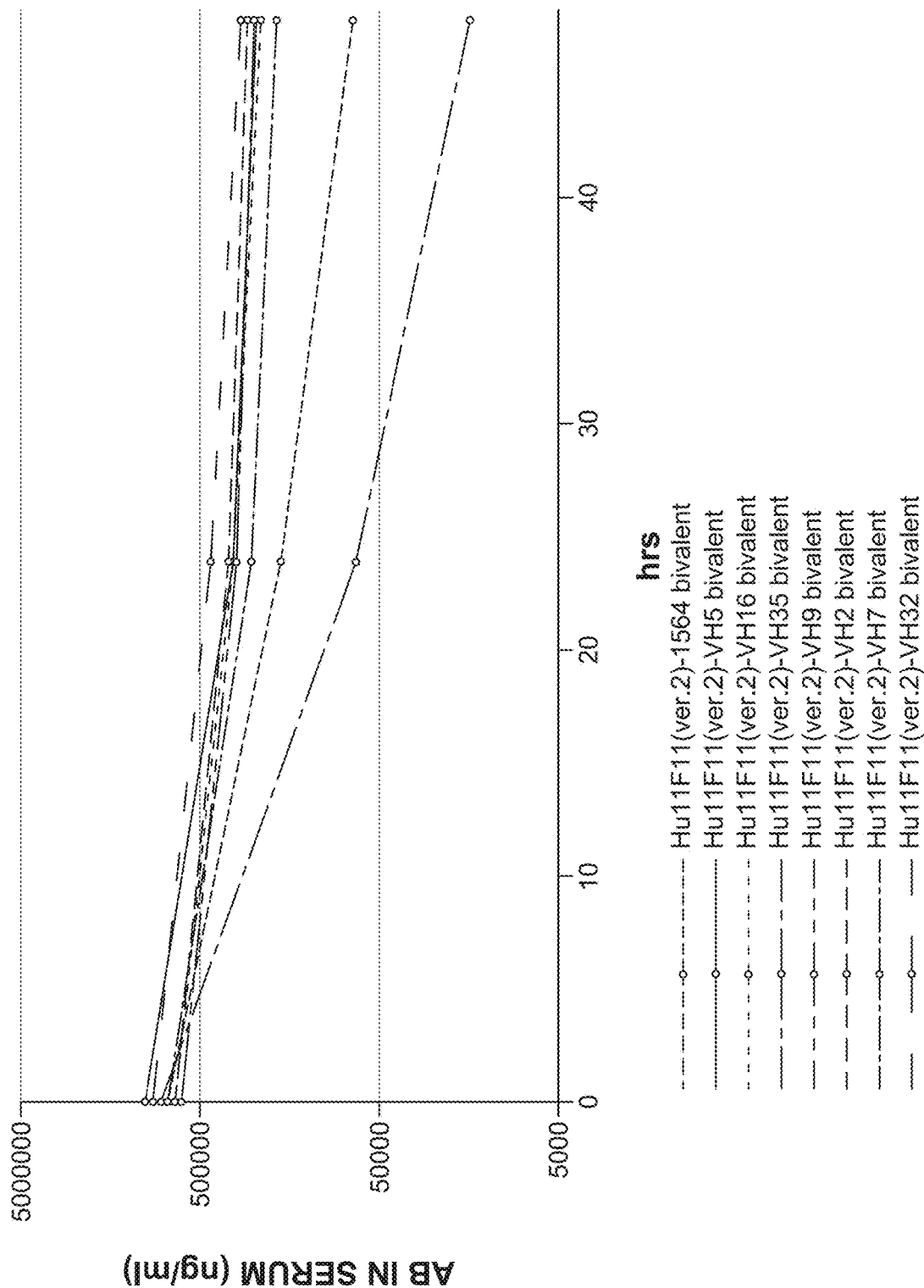

The blood levels of antibodies were analyzed by ELISA. After the goat anti-human Fc antibody was coated on a 96-well plate, an appropriate amount of the diluted sample was treated and then detected with an antibody conjugated with an anti-human Fab HRP. The analysis results are shown in FIG. 17D and FIG. 17E.

As a result, in the first test group, the monovalent form of 1564, the monovalent form of F06, and the monovalent from of C04 showed longer serum PK than bivalent of the parental 1564 clone. In the second test group, the bivalent forms of VH2, VH5, VH7, VH9, VH16, and VH32 except for the VH35 showed an increased serum PK compared to the parental 1564 bivalent.

In order to analyze the BBB-penetrating ability of the groups, CSF was extracted from the rats at 48 hours and analyzed by the same ELISA method. The analysis results are shown in FIG. 17F.

In the first test group, 1564 monovalent, F06 monovalent, and C04 monovalent forms showing an increased serum PK showed increased CSF antibody compared to parental 1564 bivalent. In the second test group, the bivalents of VH2, VH5, VH7, VH9, VH16, and VH32, which also showed an increased serum PK, showed an increased CSF antibody compared to parental 1564 bivalent. VH35 showed shorter serum PK and low CSF antibody level compared to parental 1564 bivalent.

Figure 17F:
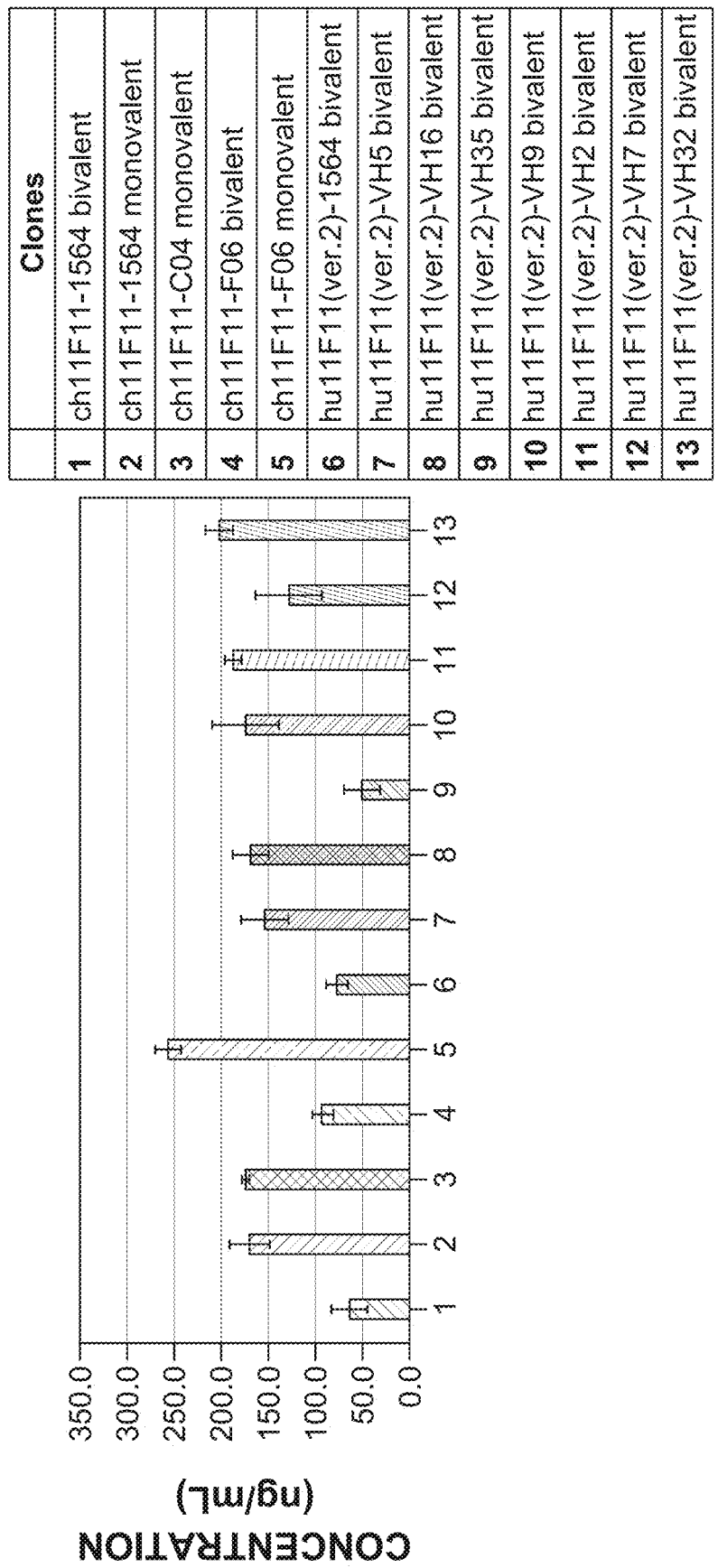

The results of FIGS. 17D, 17E, and 17F show that PK in serum is an important factor in the BBB-penetrating ability of the antibody due to the continuous BBB influx of the antibody, and that the BBB-penetrating abilities of bispecific antibodies having BBB shuttle and an increased serum PK increases. In particular, in the case of F06 monovalent form with the highest CSF antibody level, it showed about 5-fold higher CSF-penetrating ability than the parental 1564 bivalent. In Examples 18-2 and 18-3, since 1564 bivalent antibody showed about 3-fold higher CSF-penetrating ability than the single antibody in CSF, it was expected that F06 monovalent form would show a up to about 15-fold higher BBB-penetrating ability than the single antibody.

Example 22. Deamidation of IGF1R Antibody

The deamidation reaction means, for example, by attacking a peptide bond between the sides of asparagine to form a symmetrical succinimide intermediate, which is transformed into either aspartic acid or isoaspartic acid due to hydrolysis. Because this deamidation reaction can affect the continuous activity of the protein, the amino acids in the light chain and the heavy chain were substituted with other amino acids to prevent the deamidation and to secure long-term stability.

In order to confirm the deamidation site identified by in silico analysis, 1564 IGF1R antibody was left at 40° C. and the deamidation degree was measured. As a result, 4.6 to 47.3% of deamidation reactions were confirmed to occur in CDR2 and CDR3 of the light chain and CDR2 of the heavy chain as shown in FIG. 18A. In order to prevent the deamidation, the amino acids were substituted at each site as shown in FIG. 18B, and the changes in binding capacity of the IGF1R protein were analyzed depending on each amino acid substitution. The mutants showing the same binding affinity as WT 1564 were selected, and it was confirmed that the mutants having 3 or 4 mutations were the same IGF1R binding ability as WT 1564. The introduction of these mutations means that the formulation buffer storage conditions can maintain the binding affinity and maintain a stable form in the long term. Table 27 shows the analysis results.

TABLE 27

| Experimental classification | Antibody clone | Ec50(nM) | Saturation value |
|---|---|---|---|
| First | 1564(WT) | 2.15 | 1.1 |
|  | N95aH | 2.63 | 1.08 |
|  | N95aR | 2.3 | 1.17 |
|  | N95aK | 2.07 | 1.18 |
| Second | 1564(WT) | 2.66 | 0.977 |
|  | N95aD | 2.07 | 0.896 |
|  | N54D | 2.89 | 0.933 |
|  | N54Q | 2.2 | 0.885 |
| Third | 1564(WT) | 6.87 | 0.863 |
|  | N51D | 7.35 | 0.932 |

Example 23. Epitope Mapping of Anti-IGF1R Antibodies 23-1. ELISA Analysis of Anti-IGF1R Antibody, Boiled IGF1R Protein and Native IGF1R Protein This example attempted to confirm whether the anti-IGF1R antibody recognizes a linear epitope or conformational epitope. ELISA was performed with the bivalent bispecific antibodies of 1564, 48G5, 54H4, 60H6, and B11 and ECD protein of native human IGF1R or a heated protein (boiled IGF1R). The ELISA method was performed as the same as that shown in Example 15. Table 28 shows the analysis results.

TABLE 28

| Clone name | EC50 (nM) for Native IGF1R | EC50 for Boiled IGF1R (nM) |
| --- | --- | --- |
| ch11F11-1564 | 0.914 | N/A* |
| ch11F11-48G5 | 1.21 | N/A |
| ch11F11-54H4 | 2.88 | N/A |
| ch11F11-60H6 | 10 | N/A |
| ch11F11-B11 | 7.13 | 410 |

*N/A: Not available

The clones showed similar binding to ECD protein of native human IGF1R as in Example 15, but did not bind to ECD protein of boiled human IGF1 of which the tertiary structure was destroyed by applying heat. This means that the anti-IGF1R antibody of the present invention binds to a conformational epitope, but not a linear epitope.

23-2. Epitope Mapping of Anti-IGF1R Antibody

Figure 19:
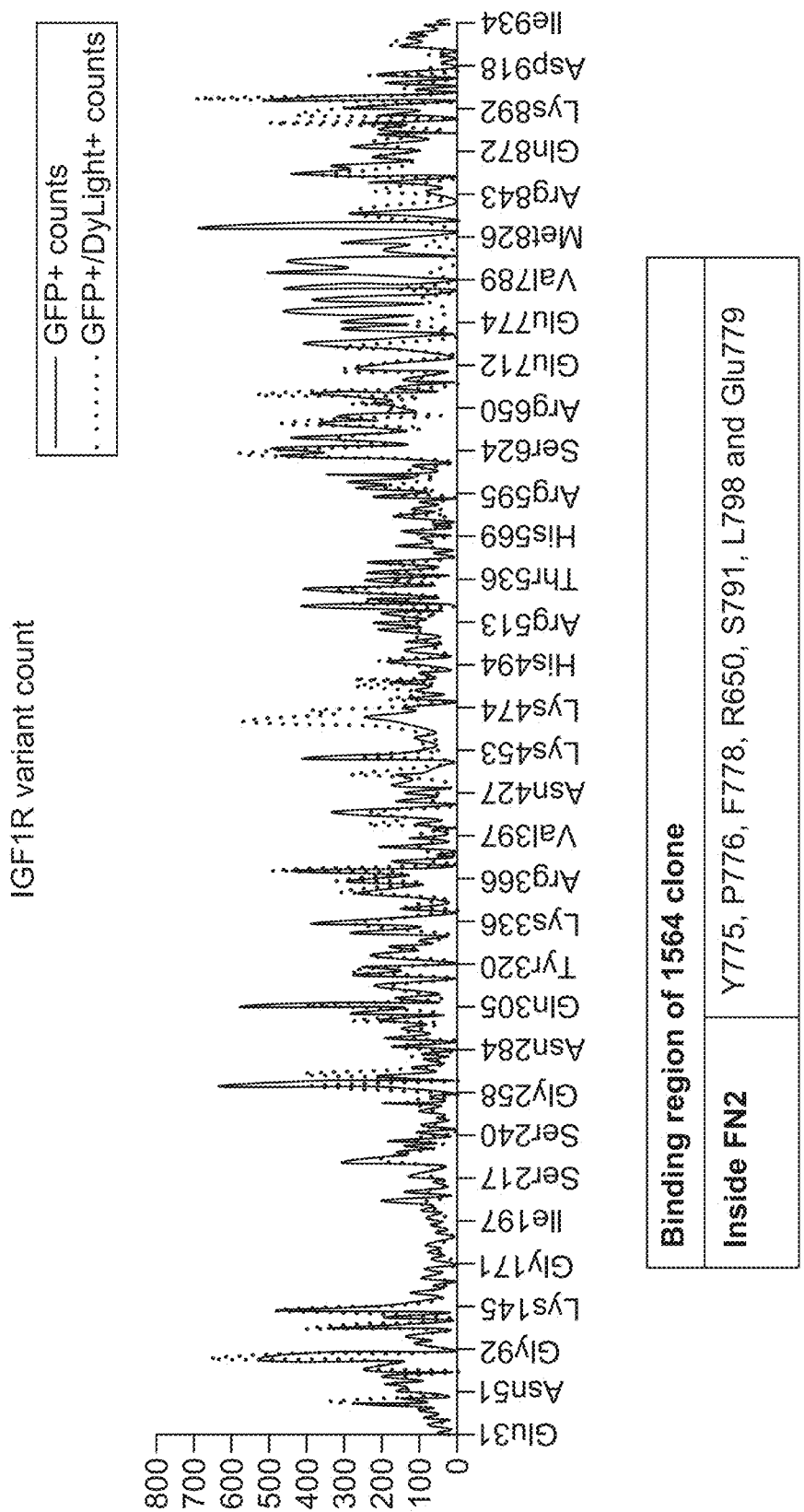
FIG. 19 is the epitope mapping results of anti-IGF1R antibody.

To analyze the conformational epitope of 1564 clone, alanine scanning was performed as follows. The OGFAR3 cell, an ovarian cancer cell line confirmed to have low IGF1R expression, was made to express the IGF1R library in which an eGFP tag was fused at N-terminus and the C-terminal kinase domain was removed. The IGF1R library contains the mutations in which the residues on the IGF1R surface are substituted with alanine. The prepared library was transfected into OVCAR3 cells. The cells identified with IGF1R expression were treated with 1564 antibody, and then labeled fluorescently by being treated with a secondary antibody labeled with DyLight650. The labeled cells were classified according to the presence or absence of IGF1R expression, the expression of IGF1R, and the presence or absence of 1564 binding, and the RNA deep sequencing was performed by using the Illumina HiSeq™ technique to analyze the frequency of each alanine mutation in the corresponding cell group. The corresponding frequency was normalized as a result for cells expressing wild-type IGF1R, and then the relative frequency was calculated to select the mutations whose number decreased in the 1564-labeled cell group. Based on this observation, it was found that the epitope of 1564 clone was located in the FN2 domain, and the residues belonging to it were Y775, P776, F778, R650, 5791, and L798. The results and the sequences recognized by the 1564 clone are shown in FIG. 19. Since these residues are not known to involve in the binding of IGF1 according to the prior literature, the results faithfully describe the properties of 1564 clone in Example 23-1.

Example 24. Comparison of Antigen Binding Affinities of Single Antibody and Bispecific Antibody 24-1: Binding Affinities of Single Antibody and Bispecific Antibody to Alpha-Synuclein Antigen When the scFv form of IGF1R antibody was linked to the alpha-synuclein antibody in IgG type, the effect on the binding affinity of the alpha-synuclein antibody was analyzed.

The alpha-synuclein aggregates were coated on a 96-well plate at a concentration of 1 µg/mL for 18 hours, and after washing, was treated with each antibody by diluting by 5 times from 400 nM. The bound antibodies were bound to anti-human Fc-HRP and then performed by color development with TMB solution, to measure the degree of binding of the antibody.

Figure 20A:
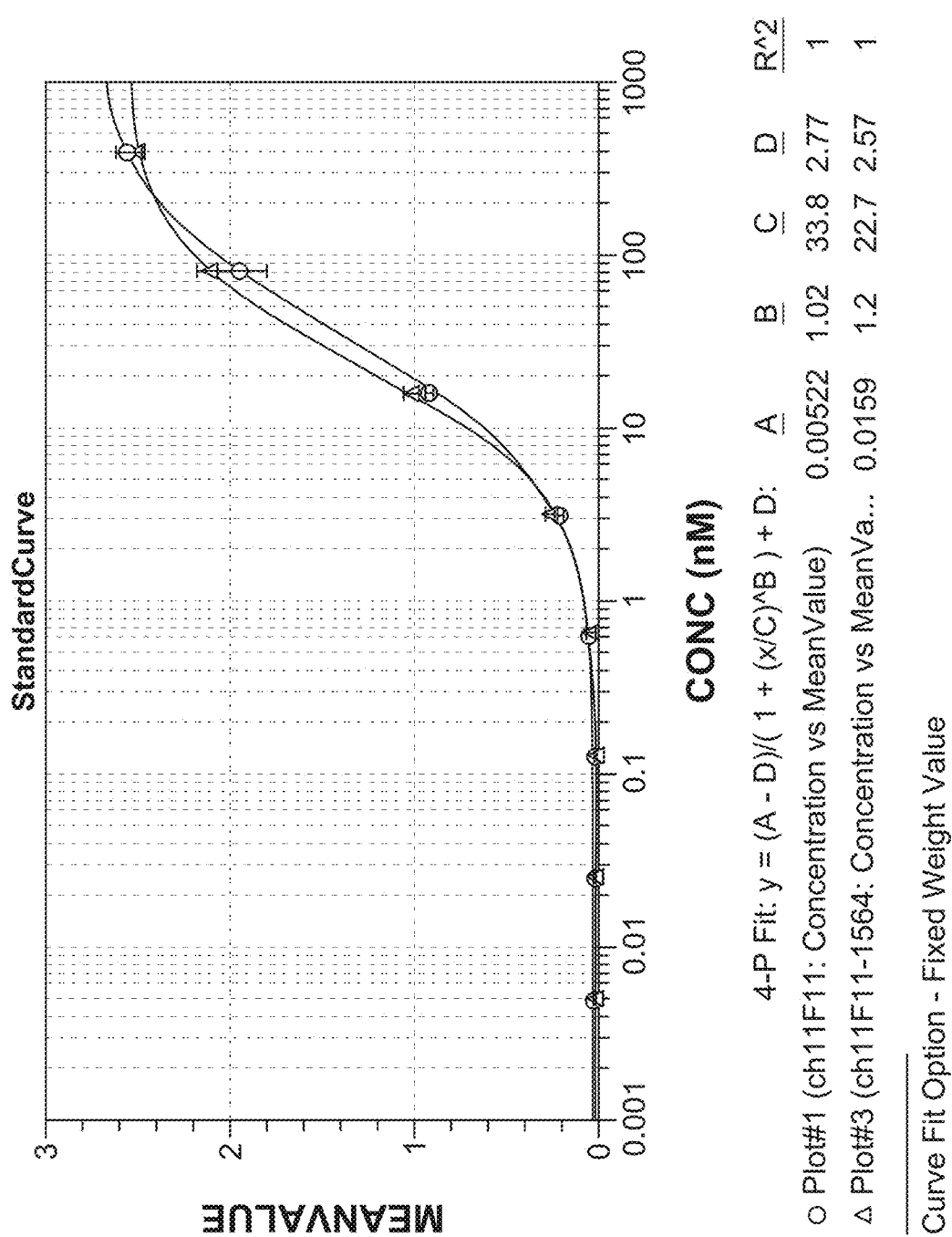
FIGS. 20A and 20B are the ELISA analysis results of measuring an affinity of the bispecific antibody of an embodiment of the present invention, to each antigen.

As shown in FIG. 20A, it was confirmed that the binding affinity to alpha-synuclein aggregates was the same in the single antibody and the bispecific antibody.

24-2: Binding Affinities of Single Antibody and Bispecific Antibody to IGF1R Antigen To compare the binding degrees of the single alpha-synuclein antibody and the bispecific antibody to the IGF1R antigen, the experiment was performed in the same manner as in Example 22.

Figure 20B:
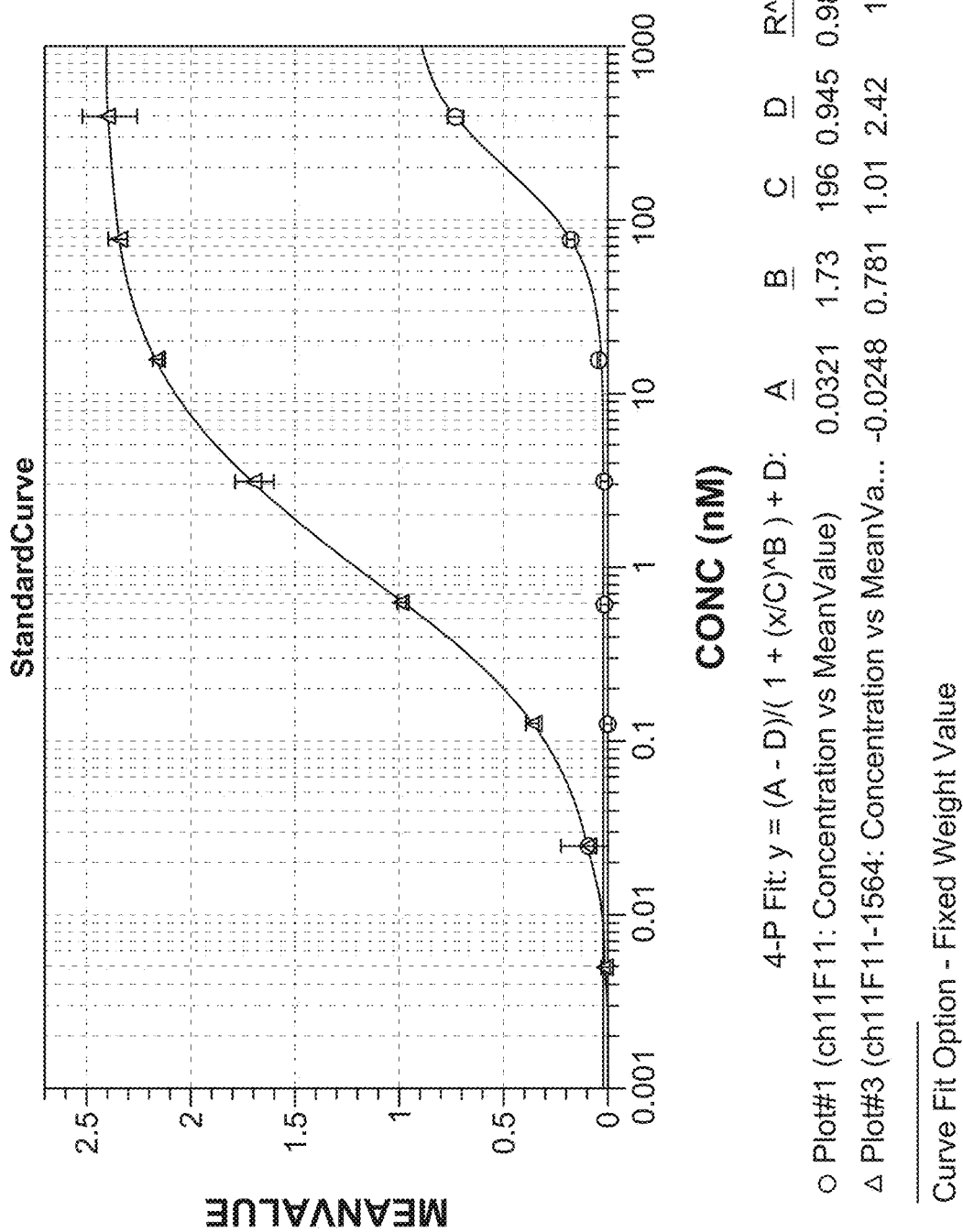

As shown in FIG. 20B, it was confirmed that the bispecific antibody having the scFv form of IGF1R antibody bound well in a concentration-dependent manner, but the single antibody having no IGF1R antibody region did not bind.

24-3: Analysis of Binding Ability of a Humanized Alpha-Synuclein Antibody

The difference in binding affinity between the bispecific chimeric antibody and the bispecific humanized antibody was analyzed by performing the experiment in the same manner as in Example 24-1.

Figure 20C:
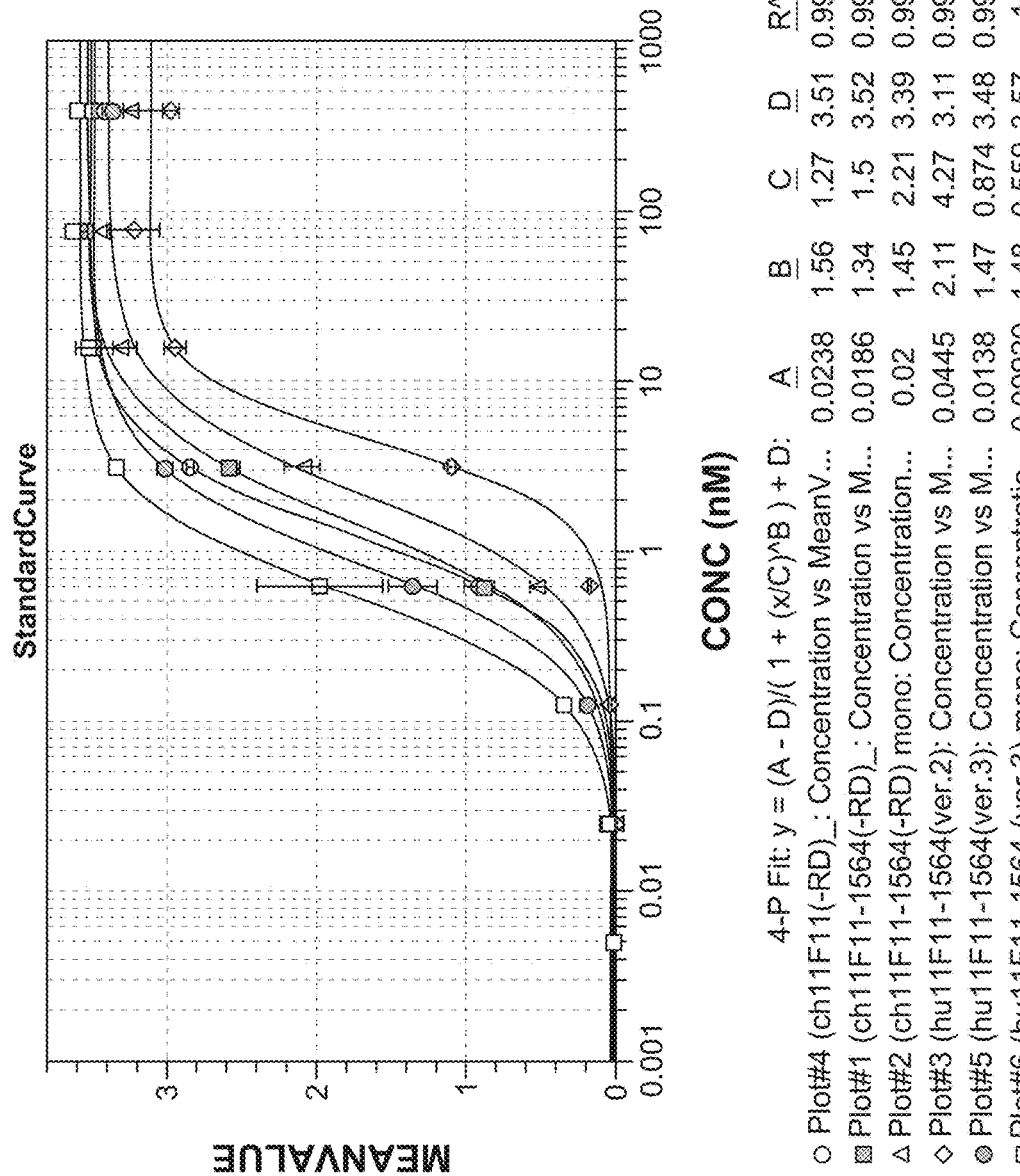
FIGS. 20C and 20D are the ELISA analysis results of comparing the chimeric antibody and the humanized antibody to each antigen.

As shown in FIG. 20C, the bispecific humanized antibodies had binding affinities to alpha-synuclein aggregates at a level similar to those of bispecific chimeric antibody, and it was confirmed that monovalent bispecific antibody with one scFv of IGF1R also exhibited the binding affinities at a level similar to chimeric antibodies.

Figure 20D:
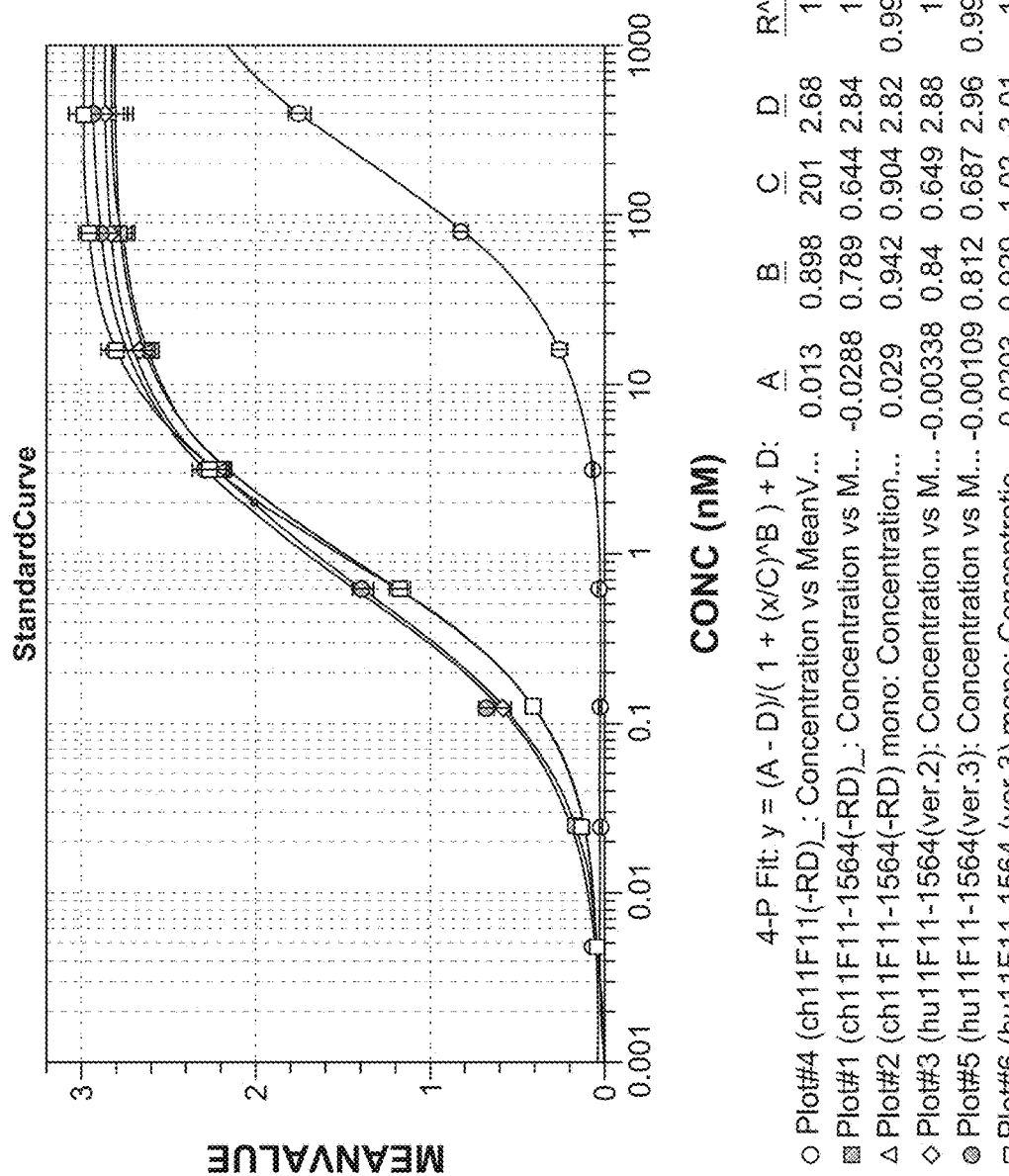

As a result of analyzing the binding affinities to IGF1R between the bispecific chimeric antibody and the bispecific humanized antibody by performing the experiment in the same manner as in Example 24-2, all bispecific antibodies represented the same binding affinity, but the single antibody having no IGF1R scFv did not bind, as shown in FIG. 20D.

These results suggest that it has the same activity and no change in the binding affinity to alpha-synuclein aggregates and IGF1R, when it is humanized to replace the mouse antibody region acting as an immunogen in the human body.

24-4: Comparison of Phagocytosis of the Single Antibody and the Bispecific Antibody Phagocytosis refers to the action of removing extracellular substances by involving in various receptors of macrophages. Various protein aggregates induce an immune response or an inflammatory reaction, which adversely affects the human body. Particularly, it is known that it is promoted through the interaction between the Fc region of the antibody and FcrR on the cell surface, when the antibody is administered to remove the alpha-synuclein aggregates. For this reason, the activity against phagocytosis of a single antibody and a bispecific antibody liked with IGF1R scFv was compared.

BV-2 microglial cells derived from mouse were used to compare phagocytosis between the single antibody and the bispecific antibody. BV-2 cells were cultured in RPMI1640 medium, prepared at a concentration of 2×10E6 cells/mL, and dispensed at 100 µL in U-bottom 96 well plates. 10 µg/mL of alpha-synuclein aggregates and 25 µg/mL of antibodies were diluted with RPMI1640 medium, mixed, and left at room temperature for 20 minutes. The mixture of alpha-synuclein aggregates and antibodies were treated with BV-2 cells and left for 15 minutes. The alpha-synuclein aggregates in the supernatant were removed by centrifugation at 1200 rpm, and washed three times with PBS buffer (pH2.5) to remove aggregates or antibodies bound to the cell surface. The cells were fixed with 4% paraformaldehyde and washed with PBS buffer. To confirm the phagocytosis of aggregates and antibodies into the cells, 0.5% Triton X-100 was added to loosen the cell membrane, washed with PBS buffer, and treated with pan-alpha-synuclein antibody for 1 hour. The bound pan-alpha-synuclein antibody was treated with an anti-rabbit-Alexa-488 antibody for 1 hour, and then FACS analysis confirmed the aggregates entering into the cell by macrophage.

Figure 20E:
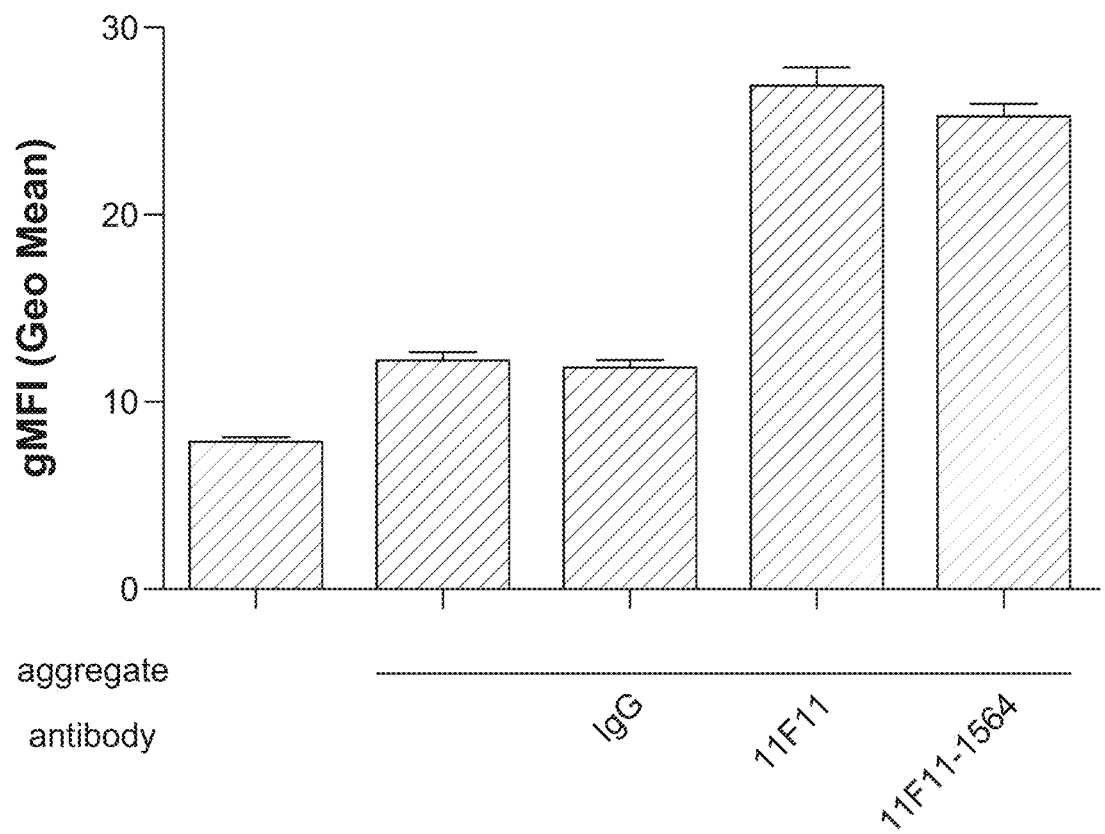
FIG. 20E is a result of evaluating the activity of the microglia phagocytosis for the bispecific antibody prepared in an embodiment of the present application.

As shown in FIG. 20E, it was confirmed that the normal human IgG did not affect macrophage and the phagocytosis of alpha-synuclein aggregates was increased, when treating with the alpha-synuclein antibody. When the single antibody and the bispecific antibody were compared, it was confirmed that the phagocytosis occurred at a similar level, and that the scFv form of IGF1R antibody bound to C-terminus of the IgG did not affect the action of the alpha-synuclein antibody.

Example 25. Evaluation of Efficacy of Bispecific Antibody

According to Example 14-6, the bivalent bispecific antibody comprised of chimeric 11F11 antibody and scFv of 1564 clone was prepared, and the bispecific antibody and the single alpha-synuclein antibody were tested for in vivo efficacy in a transgenic mouse (mThy-1 human α-synuclein, UC San Diego) overexpressing human alpha-synuclein. 2.5 mg/kg of the single antibody or human IgG, or the same mole of the bivalent bispecific antibodies were administered intraperitoneally weekly for 3 months. Five mice per a group were used, and non-transgenic littermate was used as a control. Subsequently, perfusion was performed as follows.

After the last administration was completed, the animals were anesthetized with chloral hydrate under humanitarian regulations and then perfused with 0.9% physiological saline, for the analysis of pathology in the brain. Subsequently, one half (sagittal section) of perfused brain was stored in 4% paraformaldehyde (pH 7.4, 4° C.) in phosphate buffer until the analysis time, and the other half was immediately frozen (−70° C.).

The pathological analysis was conducted as follows. The half brain fixed to paraformaldehyde was cut into continuous sections at 40 m thickness by free-floating using a vibrometer. To confirm the expression level of alpha-synuclein in the brain of each administration group, the sections containing cortex, hippocampus and striatum were incubated with alpha-synuclein antibodies (p129 α-syn antibody of aggregate marker, abcam, ab59264, or whole alpha-synuclein antibodies) at 4° C. overnight. Alternatively, in order to analyze the activity degree of astrocytes, the sections were analyzed for GFAP (glial fibrillary acidic protein) (AB5804, Millipore) or in order to analyze the neuro-inflammation degree, the sections were incubated with an antibody to IL-10 (ab9722, Abcam), respectively. Alternatively, an antibody against NeuN (Chemicon, #MAB377) was treated to analyze the degree of neuronal cell death in hippocampus. After incubation with the primary antibody, the biotin-linked goat anti-rabbit IgG (1:100, Vector Laboratories) and Avidin D-horseradish peroxidase (1:200, ABC Elite, Vector Laboratories) were treated and detected with diaminobenzidine (DAB). Each immune-stained section was observed with a bright field microscope to measure optical density. The results are disclosed in FIGS. 21A-21E.

25-1. Analysis of Alpha-Synuclein Reduction Ability by a Chimeric Antibody and a Bispecific Antibody FIG. 21A shows the result of staining and measuring cortex and hippocampus among the mouse brain tissue by using p-129 α-syn antibody after administering the antibodies to mouse for testing whether the chimeric 11F11 antibody and the bivalent bispecific antibody comprised of 1564 clone and the chimeric 11F11 antibody can remove alpha-synuclein aggregates in a mouse animal model (TG) overexpressing human alpha-synuclein. p-129 α-syn is phosphorylated form at $129^{th}$ residue and a maker of aggregates, and is represented as dark brown spots or aggregates in stained tissue.

Figure 21A:
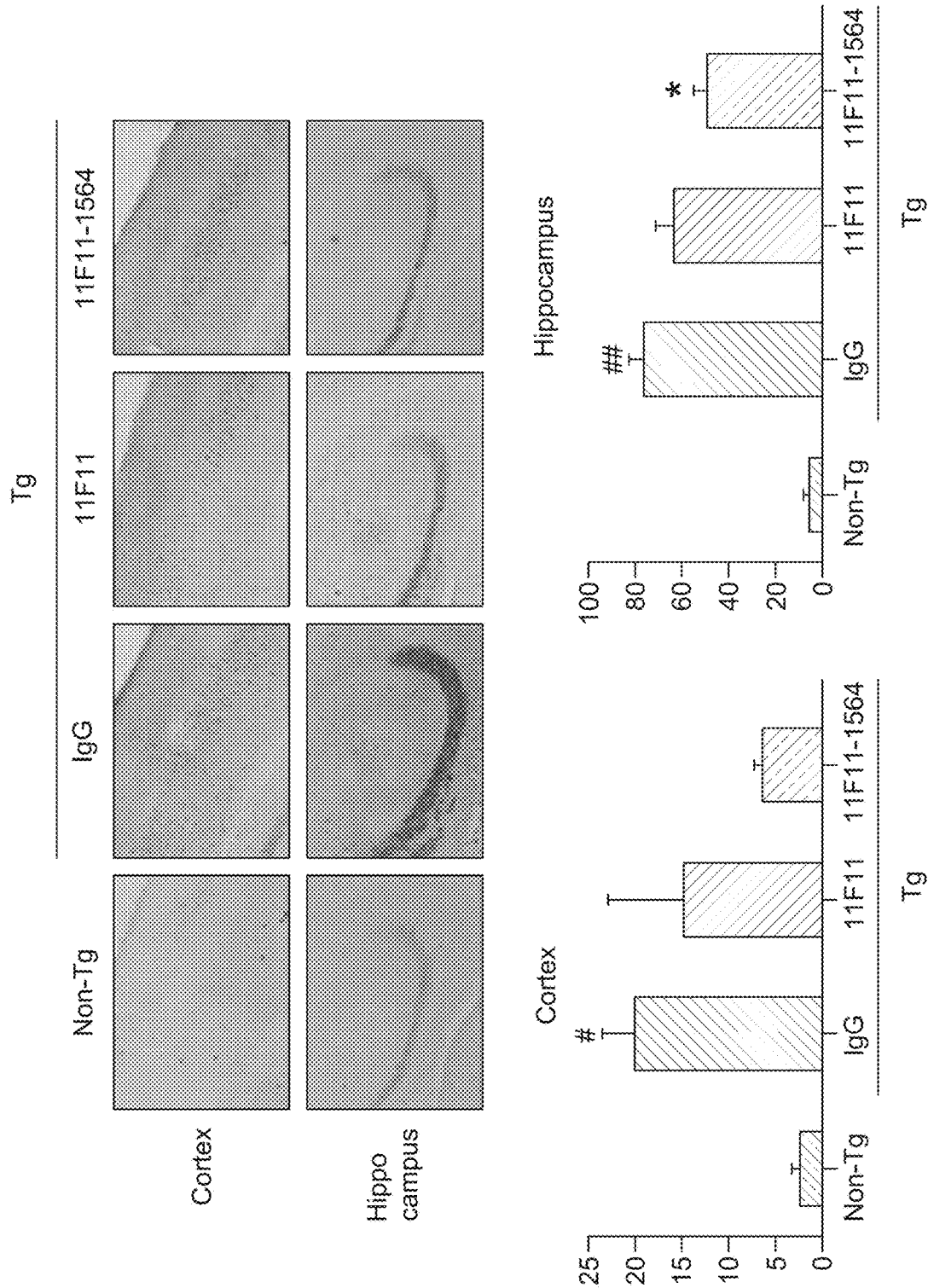
FIGS. 21A-21E are results of evaluating the efficacy in a mouse animal model for the bispecific antibody prepared in an embodiment of the present application, compared to a single antibody.
Figure 21B:
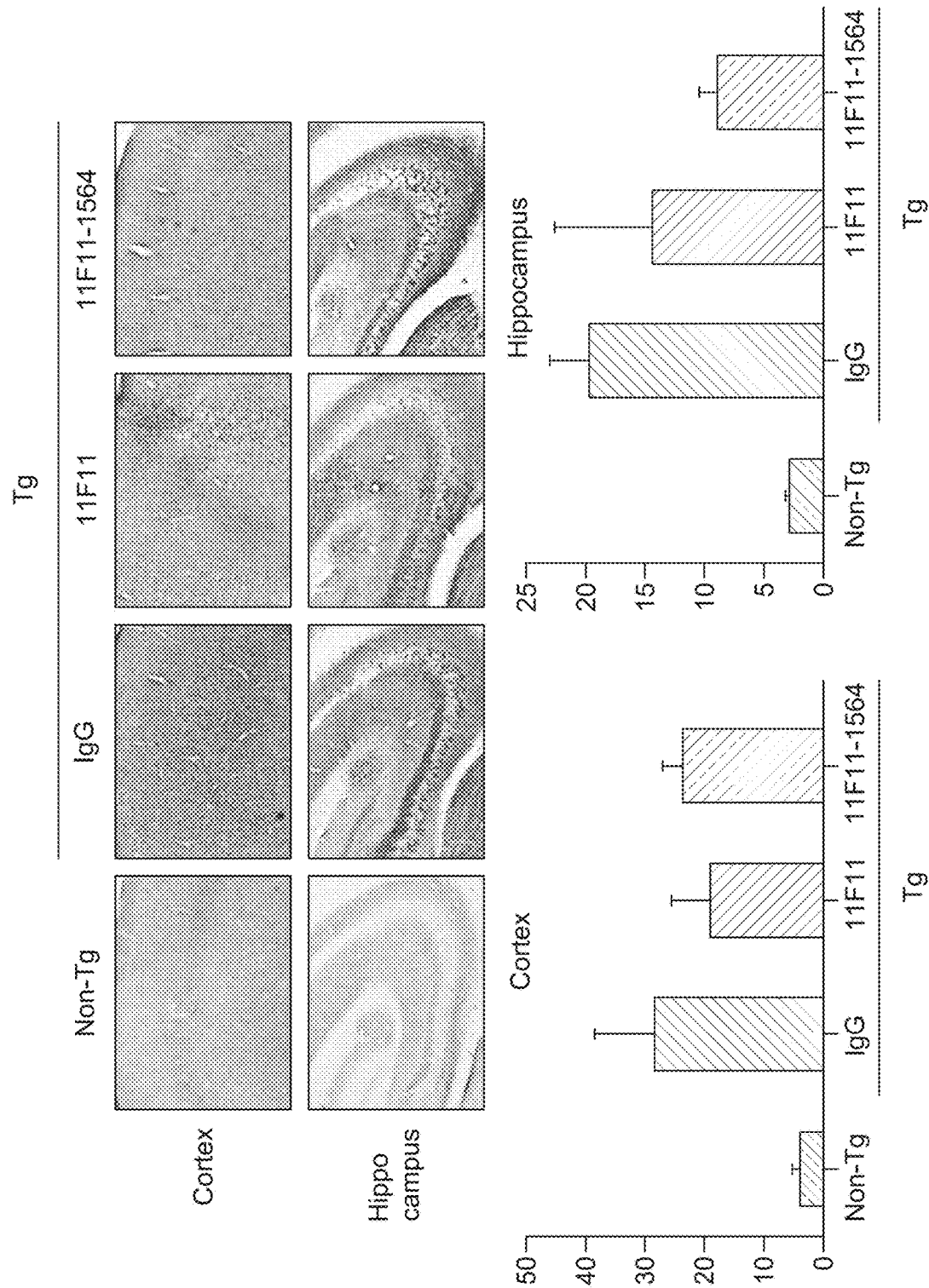

According to FIG. 21A, the IgG-treated group showed a higher staining degree of p-129 α-syn than the non-tg control group (#: one way ANOVA, p \u003c0.01). On the contrary, in the group treated with the single antibodies or the bispecific antibodies, the staining degree of p-129 α-syn or aggregates was significantly reduced. In particular, in hippocampus, the degree of reduction in the bispecific antibody treatment group was higher than that of the chimeric 11F11 antibody (*: one way ANOVA, p \003c0.05). FIG. 21B shows the experiment result in the same manner as in FIG. 21A, except for the staining with a whole alpha-synuclein antibody as a marker. The detection of all alpha-synuclein indicates that the antibody of the present application has the ability to clear the alpha-synuclein itself and inhibit the cell-to-cell transmission. In other aspects, it can also be interpreted as inhibiting the formation of aggregates from monomers or removing all monomers. The increased human alpha-synuclein in TG mouse is reduced compared to the IgG administration group by administration of the single antibodies and the bispecific antibodies. In particular, in hippocampus, the bispecific antibodies were more effective than the single antibodies.

The results indicate that the chimeric 11F11 antibody and the bispecific antibody effectively reduce alpha-synuclein and its aggregate levels in Parkinson's disease animal models even at a low dose of 2.5 mg/kg. In particular, the bispecific antibody is superior to the single antibody, which suggests that the bispecific antibody can reach the brain more than the single antibody and treat the disease effectively based on the improved BBB-penetrating ability.

25-2. Analysis of Astroglosis and Inflammatory Cytokine Level Reduction Ability of the Chimeric Antibody and the Specific Antibody Glyosis is a non-specific reaction that occurs in glial cells in response to damage to the central nervous system and is triggered by BBB damage, or the substances such as TGF-beta and interleukin. Representatively, it includes astrogliosis and GFAP protein is used as a marker. Thus, the effect of reducing the astrocytosis and inflammatory cytokine release triggering the astrocytosis were analyzed by administering the chimeric 11F11 antibody and the bispecific antibody comprised of 1564 clone and the chimeric antibody. The results of the analysis are disclosed in FIG. 21C and FIG. 21D.

Figure 21C:
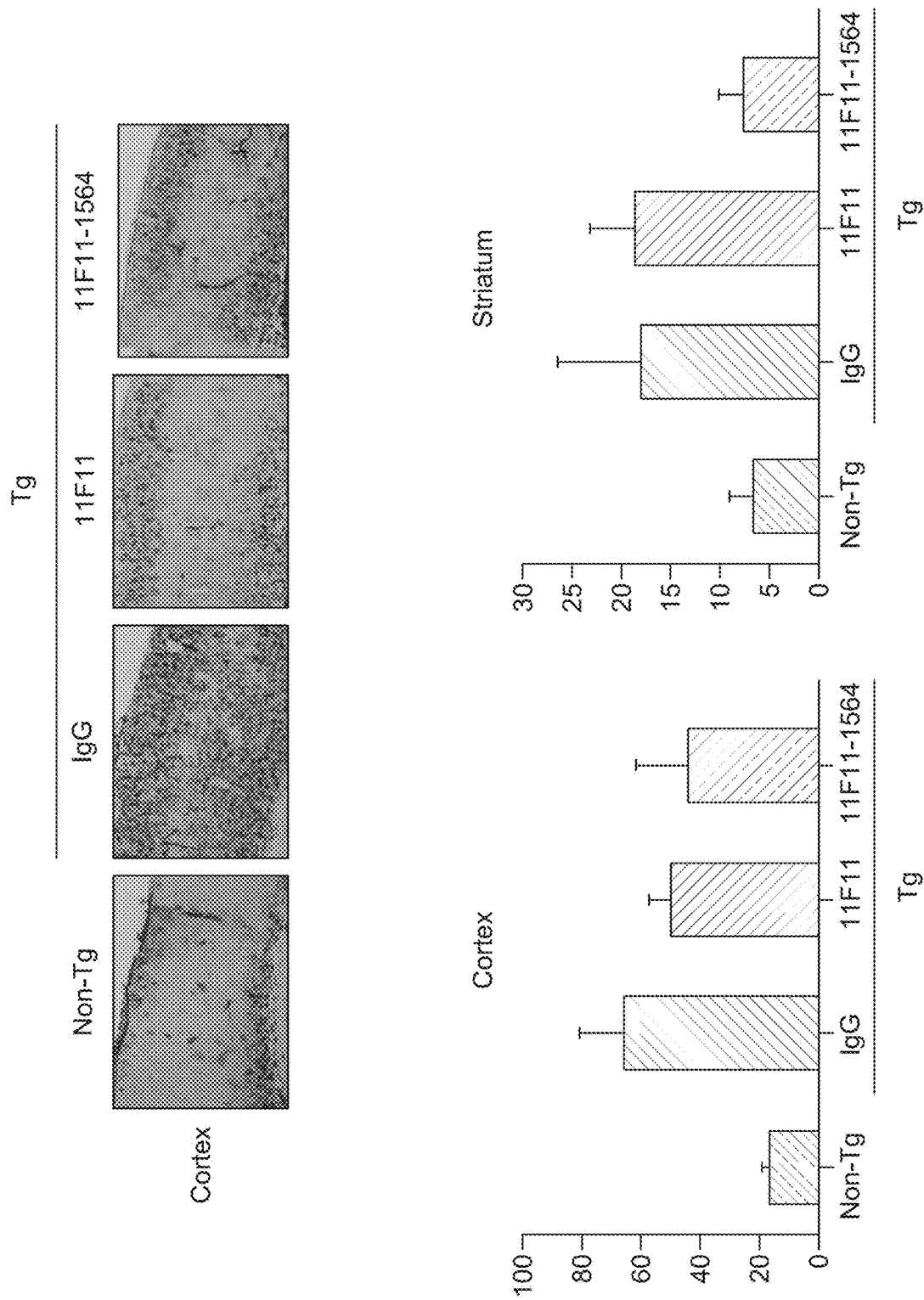

FIG. 21C shows a result of staining and measuring the mouse brain tissue using GFAP (astrogliosis) as a marker after administering the antibodies, to test whether the chimeric 11F11 antibody and the bispecific antibody comprised of 1564 clone and the chimeric antibody prepared in an example of the present invention can reduce astrogliosis in vivo. The single antibody and the bispecific antibody inhibited astrogliosis compared to the IgG control group. In particular, it was confirmed that the efficacy of the bispecific antibody was superior to that of the single antibody in striatum.

Figure 21D:
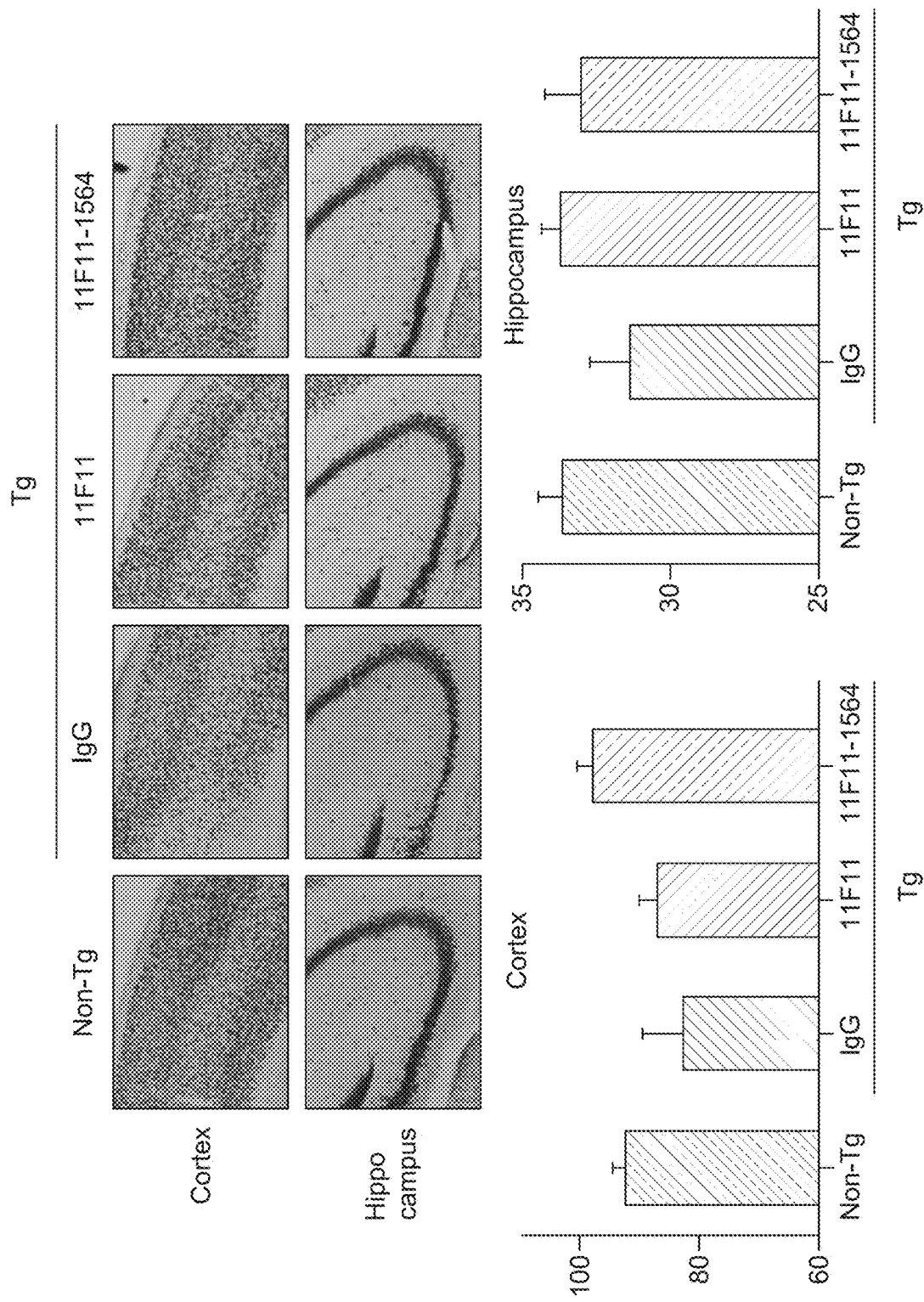

FIG. 21D shows a result of staining and measuring the mouse brain tissue using IL-1 beta antibody as a marker after administering the antibodies, to test whether the chimeric 11F11 antibody and the bispecific antibody comprised of 1564 clone and the chimeric antibody prepared in an example of the present invention can reduce inflammatory cytokines in vivo. IL-1 beta causes an inflammation, leading to the death and inflammatory response of various neurons.

In the hippocampus of rats administered by the antibodies according to the present invention, IL-1 beta was reduced in the groups administered by single antibodies and the bispecific antibodies-compared to the IgG control group, and in particular, the reduction ability of the bispecific antibody was significantly superior to that of the single antibody (##. One-way ANOVA, p \u003c0.005; *: one way ANOVA, p \u003c0.05).

As shown in the figures, the antibody according to the present invention has been shown to reduce the astrogliosis and decrease the release of inflammatory cytokine of IL-1beta, which triggers the astrogliosis, compared to the control.

25-3. Analysis of Neurodegeneration Reduction Ability of the Chimeric Antibody and the Bispecific Antibody It has been confirmed in the prior literature that the death of brain cells occurs due to the neurotoxicity and the inflammatory response of alpha-synuclein. Whether the single antibodies and the bispecific antibodies of the present invention can inhibit brain cell death caused by alpha-synuclein in vivo was analyzed.

Figure 21E:
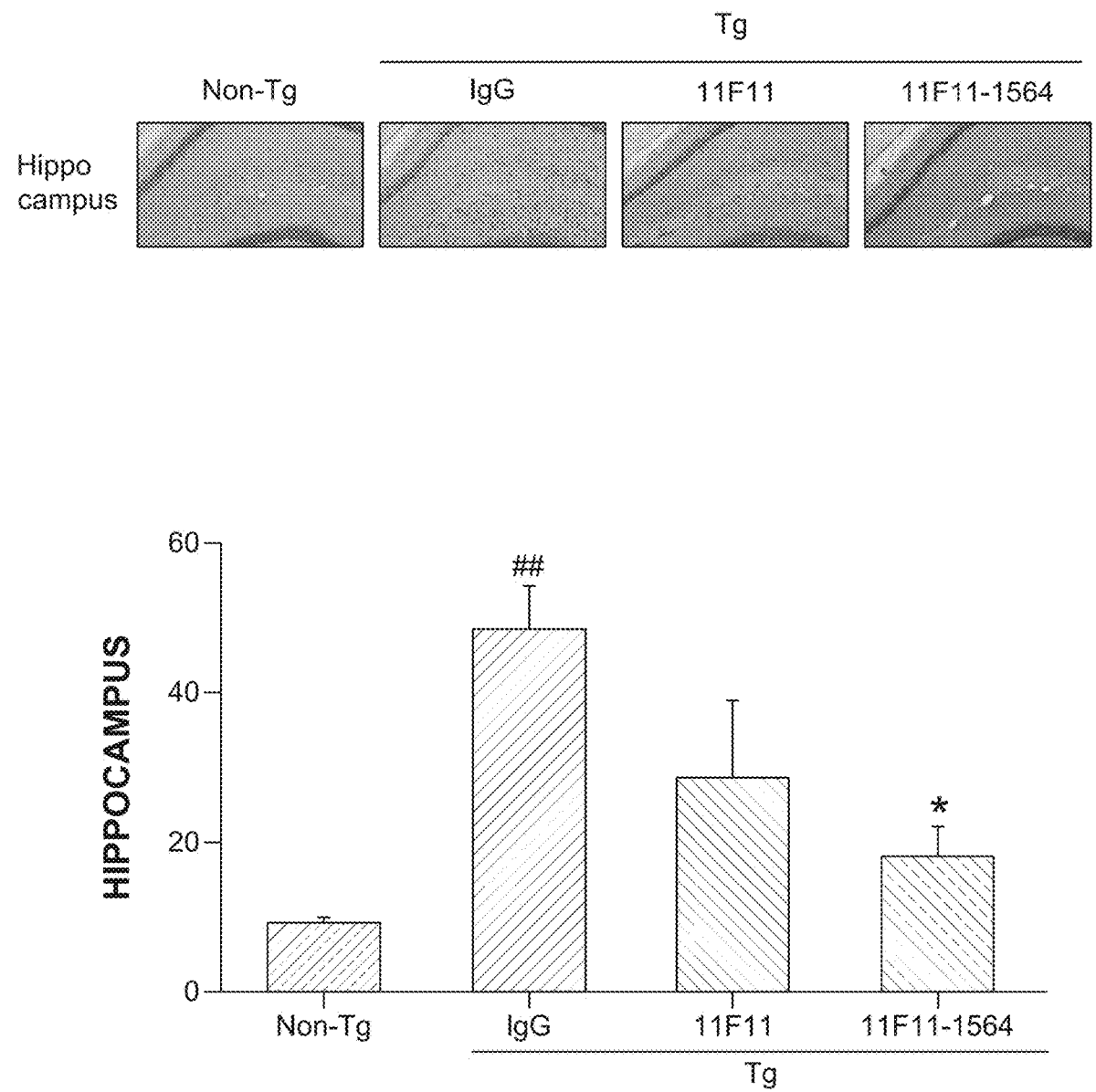

As a result of staining with NeuN which is a marker of neurons in cortex and hippocampus, it was found that both the single antibody and the bispecific antibody reduced the degree of brain cell death compared to the IgG control group. Particularly, in cortex, it was confirmed that the bispecific antibody had superior inhibition ability of brain cell death compared to the single antibody. The results are shown in FIG. 21E.

Figure 22A:
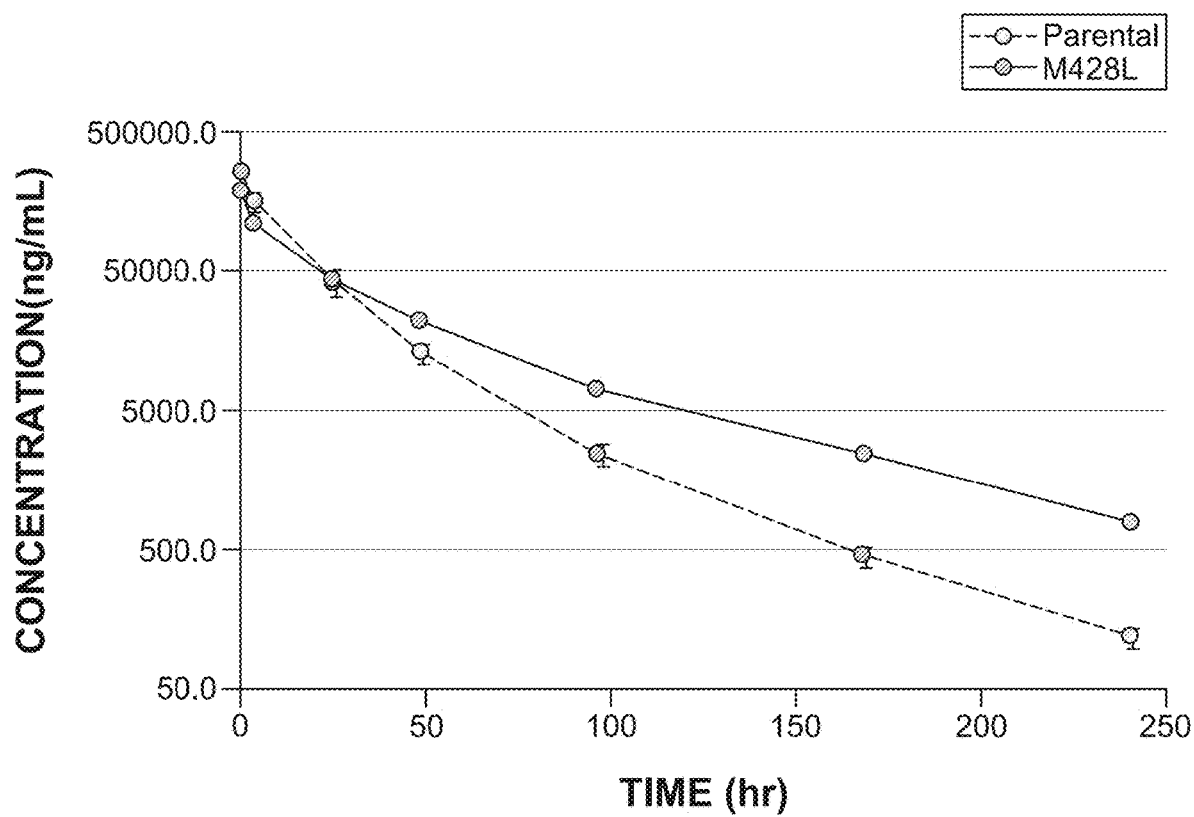
FIGS. 22A-22C are results showing an increased half-life and an improved penetration of BBB by performing Fc engineering on the bispecific antibody prepared in an embodiment of the present application.
Figure 22B:
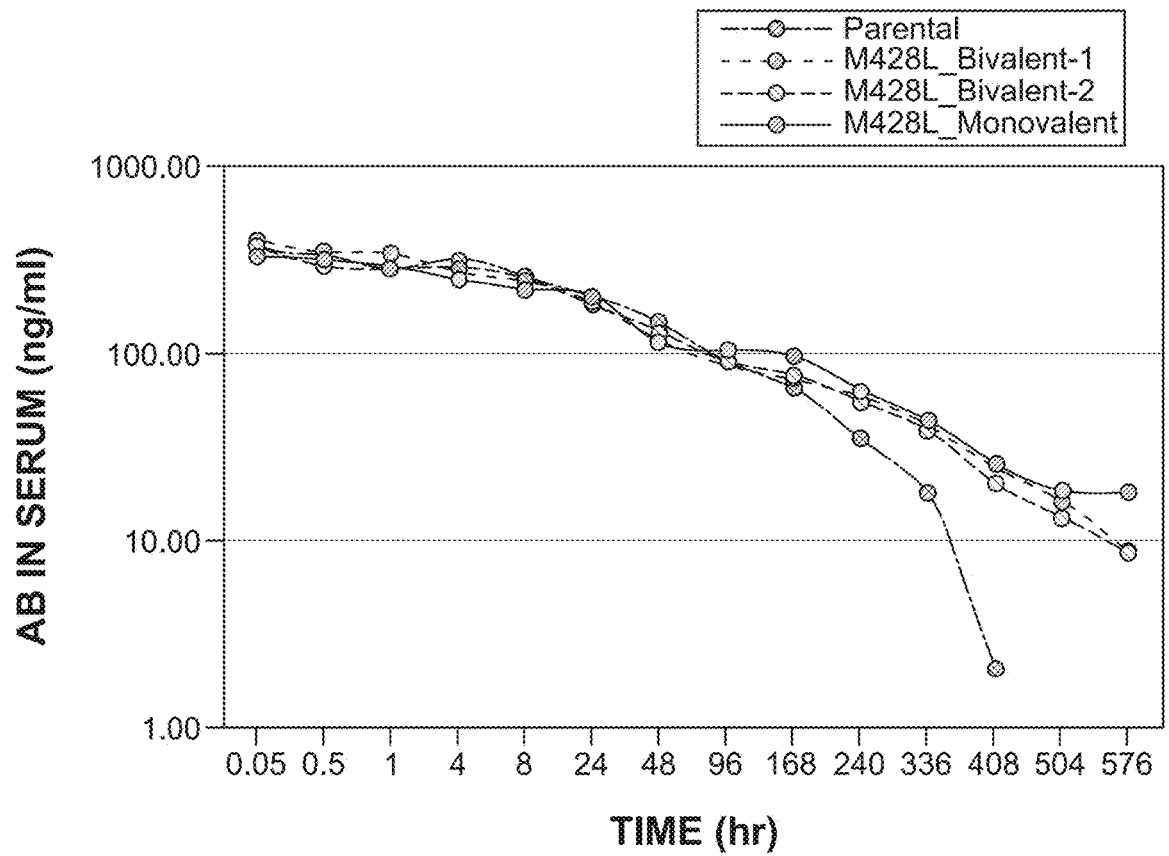
Figure 22C:
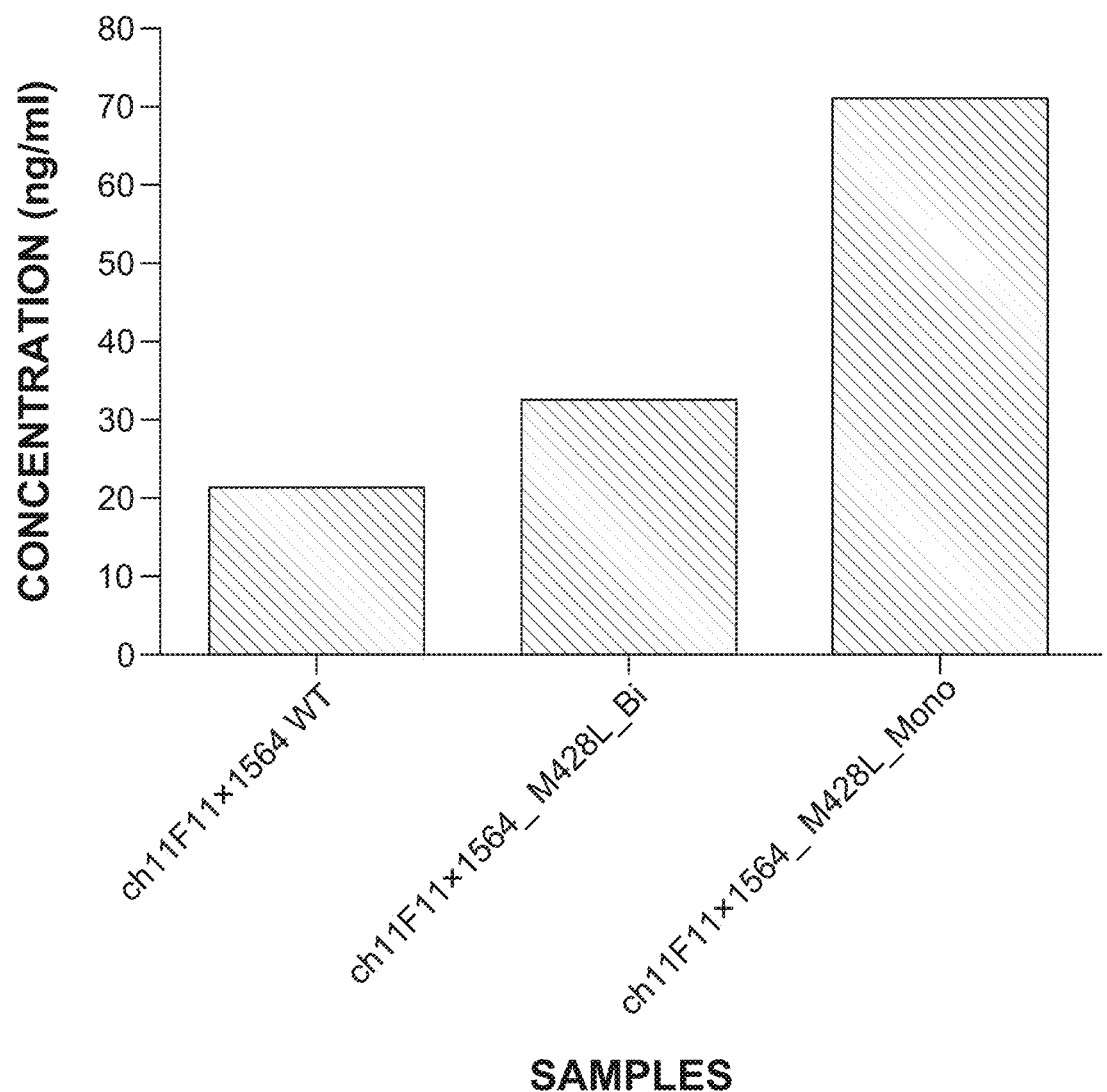

Example 26. Increased Half-Life by Fc Engineering and Improved BBB-Penetrating Ability Due to the Increased Half-Life FcRn is an important receptor on the cell membrane that increases the half-life by drawing and circulating the antibody into cells, so as to inhibit the degradation of antibody when the antibody circulates in blood vessels. The BBB-penetrating ability is also important for the transcytosis activity of antibody, but it is well known that the transcytosis activity of antibody is important in the BBB-penetrating ability, but the antibodies pass through BBB depending on the concentration of antibodies in blood vessels. For this reason, in order to increase the half-life of the bispecific antibody, the bispecific antibodies were prepared by increasing the binding affinity to FcRn by changing methionine (Met) to leucine (Leu) at 428th amino acid in the Fc region. As a result of comparing the half-life by the administration of WT bispecific antibody and M428L bispecific antibody at a concentration of 10 mg/kg to Tg mouse expressing human FcRn, the increased half-life effect was confirmed to be about 50%, as shown in FIGS. 22A-22C. To confirm the half-life increase again, the PK profiles were analyzed by administering WT bispecific antibody, M428L bivalent bispecific antibody, and M428L monovalent bispecific antibody to monkeys. In the case of the WT bispecific antibody, as shown in FIG. 22A, the blood concentration rapidly decreased after 168 hours, while the M428L bispecific antibodies with high binding affinity to FcRn maintained an improved blood concentration compared to WT. It was confirmed that the half-life increased by about 1.5 days in the M428L bispecific antibody compared to the WT bispecific antibody. In particular, in terms of clearance, the M428L monovalent bispecific antibody was the best clearance and the WT bispecific antibody showed the fastest clearance (FIG. 22B).

To verify the improved BBB passage due to the increased half-life effect, CSF was extracted at 24 hours after the antibody administration, and the amount of antibody in CSF was analyzed. After coating 100 ng/mL of IGF1R in a refrigerated state for 18 hours, CSF was added to detect the antibody bound to IGF1R. As can be seen in FIG. 22C, it was confirmed that the amount of the M428L bispecific antibody to pass BBB, which had a large amount of antibodies in the blood, was large and the M428L monovalent bispecific antibody showed improved BBB-penetrating ability than the M428L bivalent bispecific antibody, as well as the excellent BBB penetrating ability.

SEQUENCE LISTING (653 sequences)

SEQ ID NO: 1 - protein, 10 aa, Artificial Sequence
  VH CDR1 of anti-IGF1R antibody
GFTFSSYDMS

SEQ ID NO: 2 - protein, 10 aa, Artificial Sequence
  VH CDR1 of anti-IGF1R antibody
GFTFSNYDMS

SEQ ID NO: 3 - protein, 10 aa, Artificial Sequence
  VH CDR1 of anti-IGF1R antibody
GFTFSDYDMS

SEQ ID NO: 4 - protein, 10 aa, Artificial Sequence
  VH CDR1 of anti-IGF1R antibody
GFTFSDYYMS

SEQ ID NO: 5 - protein, 10 aa, Artificial Sequence
  VH CDR1 of anti-IGF1R antibody
GFTFSGYAMS

SEQ ID NO: 6 - protein, 10 aa, Artificial Sequence
  VH CDR1 of anti-IGF1R antibody
GFTFSNYAMS

SEQ ID NO: 7 - protein, 10 aa, Artificial Sequence
  VH CDR1 of anti-IGF1R antibody
GFTFSDYAMS

SEQ ID NO: 8 - protein, 10 aa, Artificial Sequence
  VH CDR1 of anti-IGF1R antibody
GFTFSSYAMS

SEQ ID NO: 9 - protein, 10 aa, Artificial Sequence
  VH CDR1 of anti-IGF1R antibody
GFTFICPILS

SEQ ID NO: 10 - protein, 17 aa, Artificial Sequence
  VH CDR2 of anti-IGF1R antibody
GIYHDGSSTYYADSVKG

SEQ ID NO: 11 - protein, 17 aa, Artificial Sequence
  VH CDR2 of anti-IGF1R antibody
SISPDGGSKYYADSVKG

SEQ ID NO: 12 - protein, 17 aa, Artificial Sequence
  VH CDR2 of anti-IGF1R antibody
AISYDNGNTYYADSVKG

SEQ ID NO: 13 - protein, 17 aa, Artificial Sequence
  VH CDR2 of anti-IGF1R antibody
AISYDQGNTYYADSVKG

SEQ ID NO: 14 - protein, 17 aa, Artificial Sequence
  VH CDR2 of anti-IGF1R antibody
SIYPNGSSKYYADSVKG

SEQ ID NO: 15 - protein, 17 aa, Artificial Sequence
  VH CDR2 of anti-IGF1R antibody
GISYSGGSTYYADSVKG

SEQ ID NO: 16 - protein, 17 aa, Artificial Sequence
  VH CDR2 of anti-IGF1R antibody
AISSDGSSAYYADSVKG

SEQ ID NO: 17 - protein, 17 aa, Artificial Sequence
  VH CDR2 of anti-IGF1R antibody
VISHSSSGTYYADSVKG

SEQ ID NO: 18 - protein, 17 aa, Artificial Sequence
  VH CDR2 of anti-IGF1R antibody
MIYSGSSSKYYADSVKG

SEQ ID NO: 19 - protein, 17 aa, Artificial Sequence
  VH CDR2 of anti-IGF1R antibody
AIYHDGGNTYYADSVKG

SEQ ID NO: 20 - protein, 17 aa, Artificial Sequence
  VH CDR2 of anti-IGF1R antibody
GISYNGGSKYYADSVKG

SEQ ID NO: 21 - protein, 17 aa, Artificial Sequence
  VH CDR2 of anti-IGF1R antibody
GISSDGGSIYYADSVKG

SEQ ID NO: 22 - protein, 17 aa, Artificial Sequence
  VH CDR2 of anti-IGF1R antibody
AISSDGGSTYYADSVKG

SEQ ID NO: 23 - protein, 17 aa, Artificial Sequence
  VH CDR2 of anti-IGF1R antibody
GIYPDGGNIYYADSVKG

SEQ ID NO: 24 - protein, 17 aa, Artificial Sequence
  VH CDR2 of anti-IGF1R antibody
AIYYDSGSIYYADSVKG

SEQ ID NO: 25 - protein, 17 aa, Artificial Sequence
  VH CDR2 of anti-IGF1R antibody
AISYDNGNKYYADSVKG

SEQ ID NO: 26 - protein, 17 aa, Artificial Sequence
  VH CDR2 of anti-IGF1R antibody
LIYPGGGNIYYADSVKG

SEQ ID NO: 27 - protein, 17 aa, Artificial Sequence
  VH CDR2 of anti-IGF1R antibody
WISSGGGSTYYADSVKG

SEQ ID NO: 28 - protein, 17 aa, Artificial Sequence
  VH CDR2 of anti-IGF1R antibody
SISYDSGSKYYADSVKG

SEQ ID NO: 29 - protein, 17 aa, Artificial Sequence
  VH CDR2 of anti-IGF1R antibody
SIYPDDGNTYYADSVKG

SEQ ID NO: 30 - protein, 17 aa, Artificial Sequence
  VH CDR2 of anti-IGF1R antibody
WISHSSSGTYYADSVKG

SEQ ID NO: 31 - protein, 17 aa, Artificial Sequence
  VH CDR2 of anti-IGF1R antibody
AISYDSGSKYYADSVKG

SEQ ID NO: 32 - protein, 17 aa, Artificial Sequence
  VH CDR2 of anti-IGF1R antibody
SIYYGSGNIYYADSVKG

SEQ ID NO: 33 - protein, 18 aa, Artificial Sequence
  VH CDR2 of anti-IGF1R antibody
AISYDNGSSIYYADSVKG

SEQ ID NO: 34 - protein, 17 aa, Artificial Sequence
  VH CDR2 of anti-IGF1R antibody
AISWDKAQPYYADSVKG

SEQ ID NO: 35 - protein, 17 aa, Artificial Sequence
  VH CDR2 of anti-IGF1R antibody
AISWDQGNSYYADSVKG

SEQ ID NO: 36 - protein, 17 aa, Artificial Sequence
  VH CDR2 of anti-IGF1R antibody
AISWGQGKTYYADSVKG

SEQ ID NO: 37 - protein, 17 aa, Artificial Sequence
  VH CDR2 of anti-IGF1R antibody
AISYDNGQTYYADSVKG

SEQ ID NO: 38 - protein, 17 aa, Artificial Sequence
  VH CDR2 of anti-IGF1R antibody
AISGSNGNTYYADSVKG

SEQ ID NO: 39 - protein, 17 aa, Artificial Sequence
  VH CDR2 of anti-IGF1R antibody
AISGSQGNTYYADSVKG

SEQ ID NO: 40 - protein, 17 aa, Artificial Sequence
  VH CDR2 of anti-IGF1R antibody
AISGDNGSTYYADSVKG

SEQ ID NO: 41 - protein, 17 aa, Artificial Sequence
  VH CDR2 of anti-IGF1R antibody
AISGDQGSTYYADSVKG

SEQ ID NO: 42 - protein, 17 aa, Artificial Sequence
  VH CDR2 of anti-IGF1R antibody
AISYSNGNTYYADSVKG

SEQ ID NO: 43 - protein, 17 aa, Artificial Sequence
  VH CDR2 of anti-IGF1R antibody
AISYSQGNTYYADSVKG

SEQ ID NO: 44 - protein, 17 aa, Artificial Sequence
  VH CDR2 of anti-IGF1R antibody
AISYDNGSTYYADSVKG

SEQ ID NO: 45 - protein, 17 aa, Artificial Sequence
  VH CDR2 of anti-IGF1R antibody
AISYDQGSTYYADSVKG

SEQ ID NO: 46 - protein, 17 aa, Artificial Sequence
  VH CDR2 of anti-IGF1R antibody
AISGDNGNTYYADSVKG

SEQ ID NO: 47 - protein, 17 aa, Artificial Sequence
  VH CDR2 of anti-IGF1R antibody
AISGDQGNTYYADSVKG

SEQ ID NO: 48 - protein, 17 aa, Artificial Sequence
  VH CDR2 of anti-IGF1R antibody
AISGSNGSTYYADSVKG

SEQ ID NO: 49 - protein, 17 aa, Artificial Sequence
  VH CDR2 of anti-IGF1R antibody
AISYDDGNTYYADSVKG

SEQ ID NO: 50 - protein, 18 aa, Artificial Sequence
  VH CDR3 of anti-IGF1R antibody
VSGTLSEPYAFFFNAMDV

SEQ ID NO: 51 - protein, 12 aa, Artificial Sequence
  VH CDR3 of anti-IGF1R antibody
DGGTHWLSLFDY

SEQ ID NO: 52 - protein, 12 aa, Artificial Sequence
  VH CDR3 of anti-IGF1R antibody
GVLTTLMNWFDY

SEQ ID NO: 53 - protein, 18 aa, Artificial Sequence
  VH CDR3 of anti-IGF1R antibody
AGINCTTLRCSSYDAMDV

SEQ ID NO: 54 - protein, 18 aa, Artificial Sequence
  VH CDR3 of anti-IGF1R antibody
VGLACTPHTCSSYDAMDV

SEQ ID NO: 55 - protein, 18 aa, Artificial Sequence
  VH CDR3 of anti-IGF1R antibody
ATIYTSDAPWSSYDAMDV

SEQ ID NO: 56 - protein, 18 aa, Artificial Sequence
  VH CDR3 of anti-IGF1R antibody
VGVACGETDCSSYDAMDV

SEQ ID NO: 57 - protein, 18 aa, Artificial Sequence
  VH CDR3 of anti-IGF1R antibody
ASIACTLQACSYDNAMDV

SEQ ID NO: 58 - protein, 18 aa, Artificial Sequence
  VH CDR3 of anti-IGF1R antibody
AASPCNVHDCSYDYAMDV

SEQ ID NO: 59 - protein, 18 aa, Artificial Sequence
  VH CDR3 of anti-IGF1R antibody
VGIMCSETGCSYDNAMDV

SEQ ID NO: 60 - protein, 18 aa, Artificial Sequence
  VH CDR3 of anti-IGF1R antibody
YASPTWLHILYYSDAMDV

SEQ ID NO: 61 - protein, 18 aa, Artificial Sequence
  VH CDR3 of anti-IGF1R antibody
ALIPCTPEGCYSYDAMDV

SEQ ID NO: 62 - protein, 12 aa, Artificial Sequence
  VH CDR3 of anti-IGF1R antibody
DPWFSRWTAFDY

SEQ ID NO: 63 - protein, 18 aa, Artificial Sequence
  VH CDR3 of anti-IGF1R antibody
GIGQCELRECSSDDGMDV

SEQ ID NO: 64 - protein, 18 aa, Artificial Sequence
  VH CDR3 of anti-IGF1R antibody
AVSECNPLNCSYSDAMDV

SEQ ID NO: 65 - protein, 18 aa, Artificial Sequence
  VH CDR3 of anti-IGF1R antibody
VILGCSKHSCPSSDAMDV

SEQ ID NO: 66 - protein, 18 aa, Artificial Sequence
  VH CDR3 of anti-IGF1R antibody
AGVACTEHMCSSYDAMDV

SEQ ID NO: 67 - protein, 18 aa, Artificial Sequence
  VH CDR3 of anti-IGF1R antibody
GRVPCHPGGCSYAYGMDV

SEQ ID NO: 68 - protein, 18 aa, Artificial Sequence
  VH CDR3 of anti-IGF1R antibody
LGSLFPNATASYAYGMDV

SEQ ID NO: 69 - protein, 18 aa, Artificial Sequence
  VH CDR3 of anti-IGF1R antibody
AGILCTPTHCSSYDAMDV

SEQ ID NO: 70 - protein, 12 aa, Artificial Sequence
  VH CDR3 of anti-IGF1R antibody
DGWTPDGTHFDY

SEQ ID NO: 71 - protein, 18 aa, Artificial Sequence
  VH CDR3 of anti-IGF1R antibody
VGLSCAETACSSYDAMDV

SEQ ID NO: 72 - protein, 18 aa, Artificial Sequence
  VH CDR3 of anti-IGF1R antibody
VGLDCDTTKCSSYDAMDV

SEQ ID NO: 73 - protein, 18 aa, Artificial Sequence
  VH CDR3 of anti-IGF1R antibody
AVRPCTDLHCSSDDAMDV

SEQ ID NO: 74 - protein, 18 aa, Artificial Sequence
  VH CDR3 of anti-IGF1R antibody
VGRMCNITHCSSYDAMDV

SEQ ID NO: 75 - protein, 12 aa, Artificial Sequence
  VH CDR3 of anti-IGF1R antibody
DLTAPDGSSFDY

SEQ ID NO: 76 - protein, 18 aa, Artificial Sequence
  VH CDR3 of anti-IGF1R antibody
VGLECTVEHCYSYDGMDV

SEQ ID NO: 77 - protein, 12 aa, Artificial Sequence
  VH CDR3 of anti-IGF1R antibody
GVLTTLANWFDY

SEQ ID NO: 78 - protein, 12 aa, Artificial Sequence
  VH CDR3 of anti-IGF1R antibody
GVLTTLMNWFDS

SEQ ID NO: 79 - protein, 12 aa, Artificial Sequence
  VH CDR3 of anti-IGF1R antibody
GVLTTLANWFDS

SEQ ID NO: 80 - protein, 12 aa, Artificial Sequence
  VH CDR3 of anti-IGF1R antibody
GVLTTLMCLRHL

SEQ ID NO: 81 - protein, 25 aa, Artificial Sequence
  H-FR1 of anti-IGF1R antibody
EVQLLESGGGLVQPGGSLRLSCAAS

SEQ ID NO: 82 - protein, 25 aa, Artificial Sequence
  H-FR1 of anti-IGF1R antibody
EVQLLESGGGLVQTGGSLRLSCAAS

SEQ ID NO: 83 - protein, 25 aa, Artificial Sequence
  H-FR1 of anti-IGF1R antibody
EVQLLESGGGLAQPGGSLRLSCAAS

SEQ ID NO: 84 - protein, 25 aa, Artificial Sequence
  H-FR1 of anti-IGF1R antibody
EVQLLESGGGLVQPGGSLRRSCAAS

SEQ ID NO: 85 - protein, 14 aa, Artificial Sequence
  H-FR2 of anti-IGF1R antibody
WVRQAPGKGLEWVS

SEQ ID NO: 86 - protein, 14 aa, Artificial Sequence
  H-FR2 of anti-IGF1R antibody
WVRQAPGKCLEWVS

SEQ ID NO: 87 - protein, 32 aa, Artificial Sequence
  H-FR3 of anti-IGF1R antibody
RFTISRDNSKNTLYLQMNSLRAEDTAVYYCAK

SEQ ID NO: 88 - protein, 32 aa, Artificial Sequence; identical to SEQ ID NO: 87
  H-FR3 of anti-IGF1R antibody

SEQ ID NO: 89 - protein, 32 aa, Artificial Sequence
  H-FR3 of anti-IGF1R antibody
RFTISRDNSKNTLYLQMNSLRAEDTAVYYCAR

SEQ ID NO: 90 - protein, 32 aa, Artificial Sequence
  H-FR3 of anti-IGF1R antibody
RFTISRDNSKNTLYLQMNSLRAEDAAVYYCAK

SEQ ID NO: 91 - protein, 32 aa, Artificial Sequence
  H-FR3 of anti-IGF1R antibody
RFTISRDNPKNTLYLQMNSLRAEDTAVYYCAK

SEQ ID NO: 92 - protein, 11 aa, Artificial Sequence
  H-FR4 of anti-IGF1R antibody
WGQGTLVTVSS

SEQ ID NO: 93 - protein, 11 aa, Artificial Sequence
  H-FR4 of anti-IGF1R antibody
WGQGTLVTVSS

SEQ ID NO: 94 - protein, 11 aa, Artificial Sequence
  H-FR4 of anti-IGF1R antibody
WGQGTQVTVSS

SEQ ID NO: 95 - protein, 11 aa, Artificial Sequence
  H-FR4 of anti-IGF1R antibody
WGQGSLVTVSS

SEQ ID NO: 96 - protein, 13 aa, Artificial Sequence
  VL CDR1 of anti-IGF1R antibody
TGSSSNIGSNAVN

SEQ ID NO: 97 - protein, 13 aa, Artificial Sequence
  VL CDR1 of anti-IGF1R antibody
TGSSSNIGNNTVS

SEQ ID NO: 98 - protein, 13 aa, Artificial Sequence
  VL CDR1 of anti-IGF1R antibody
TGSSSNIGSNDVS

SEQ ID NO: 99 - protein, 13 aa, Artificial Sequence
  VL CDR1 of anti-IGF1R antibody
SGSSSNIGNNDVS

SEQ ID NO: 100 - protein, 13 aa, Artificial Sequence
  VL CDR1 of anti-IGF1R antibody
TGSSSNIGSNTVY

SEQ ID NO: 101 - protein, 13 aa, Artificial Sequence
  VL CDR1 of anti-IGF1R antibody
SGSSSNIGSNTVT

SEQ ID NO: 102 - protein, 13 aa, Artificial Sequence
  VL CDR1 of anti-IGF1R antibody
SGSSSNIGSNAVT

SEQ ID NO: 103 - protein, 13 aa, Artificial Sequence
  VL CDR1 of anti-IGF1R antibody
TGSSSNIGNNDVS

SEQ ID NO: 104 - protein, 13 aa, Artificial Sequence
  VL CDR1 of anti-IGF1R antibody
SGSSSNIGNNAVT

SEQ ID NO: 105 - protein, 13 aa, Artificial Sequence
  VL CDR1 of anti-IGF1R antibody
SGSSSNIGNNDVD

SEQ ID NO: 106 - protein, 13 aa, Artificial Sequence
  VL CDR1 of anti-IGF1R antibody
SGSSSNIGNNAVN

SEQ ID NO: 107 - protein, 13 aa, Artificial Sequence
  VL CDR1 of anti-IGF1R antibody
TGSSSNIGNNDVN

SEQ ID NO: 108 - protein, 13 aa, Artificial Sequence
  VL CDR1 of anti-IGF1R antibody
SGSSSNIGNNNVT

SEQ ID NO: 109 - protein, 13 aa, Artificial Sequence
  VL CDR1 of anti-IGF1R antibody
SGSSFNIGSNDVS

SEQ ID NO: 110 - protein, 13 aa, Artificial Sequence
  VL CDR1 of anti-IGF1R antibody
SGSSSNIGSNDVS

SEQ ID NO: 111 - protein, 13 aa, Artificial Sequence
  VL CDR1 of anti-IGF1R antibody
SGSSSNIGNNDVN

SEQ ID NO: 112 - protein, 13 aa, Artificial Sequence
  VL CDR1 of anti-IGF1R antibody
TGSSSNIGSNYVS

SEQ ID NO: 113 - protein, 13 aa, Artificial Sequence
  VL CDR1 of anti-IGF1R antibody
TGSSSNIGSNTVN

SEQ ID NO: 114 - protein, 7 aa, Artificial Sequence
  VL CDR2 of anti-IGF1R antibody
SNSHRPS

SEQ ID NO: 115 - protein, 7 aa, Artificial Sequence
  VL CDR2 of anti-IGF1R antibody
YDNHRPS

SEQ ID NO: 116 - protein, 7 aa, Artificial Sequence
  VL CDR2 of anti-IGF1R antibody
ANSNRPS

SEQ ID NO: 117 - protein, 7 aa, Artificial Sequence
  VL CDR2 of anti-IGF1R antibody
AQSNRPS

SEQ ID NO: 118 - protein, 7 aa, Artificial Sequence
  VL CDR2 of anti-IGF1R antibody
DNNHRPS

SEQ ID NO: 119 - protein, 7 aa, Artificial Sequence
  VL CDR2 of anti-IGF1R antibody
SDSNRPS

SEQ ID NO: 120 - protein, 7 aa, Artificial Sequence
  VL CDR2 of anti-IGF1R antibody
ADSKRPS

SEQ ID NO: 121 - protein, 7 aa, Artificial Sequence
  VL CDR2 of anti-IGF1R antibody
DDNHRPS

SEQ ID NO: 122 - protein, 7 aa, Artificial Sequence
  VL CDR2 of anti-IGF1R antibody
ANSHRPS

SEQ ID NO: 123 - protein, 7 aa, Artificial Sequence
  VL CDR2 of anti-IGF1R antibody
DDSQRPS

SEQ ID NO: 124 - protein, 7 aa, Artificial Sequence
  VL CDR2 of anti-IGF1R antibody
YDSQRPS

SEQ ID NO: 125 - protein, 7 aa, Artificial Sequence
  VL CDR2 of anti-IGF1R antibody
DDSHRPS

SEQ ID NO: 126 - protein, 7 aa, Artificial Sequence
  VL CDR2 of anti-IGF1R antibody
DDSKRPS

SEQ ID NO: 127 - protein, 7 aa, Artificial Sequence
  VL CDR2 of anti-IGF1R antibody
SNSKRPS

SEQ ID NO: 128 - protein, 7 aa, Artificial Sequence
  VL CDR2 of anti-IGF1R antibody
DDNQRPS

SEQ ID NO: 129 - protein, 7 aa, Artificial Sequence
  VL CDR2 of anti-IGF1R antibody
DNSKRPS

SEQ ID NO: 130 - protein, 7 aa, Artificial Sequence
  VL CDR2 of anti-IGF1R antibody
DDSNRPS

SEQ ID NO: 131 - protein, 7 aa, Artificial Sequence
  VL CDR2 of anti-IGF1R antibody
SDSQRPS

SEQ ID NO: 132 - protein, 7 aa, Artificial Sequence
  VL CDR2 of anti-IGF1R antibody
ADSNRPS

SEQ ID NO: 133 - protein, 11 aa, Artificial Sequence
  VL CDR3 of anti-IGF1R antibody
ATWDYSLSGYV

SEQ ID NO: 134 - protein, 11 aa, Artificial Sequence
  VL CDR3 of anti-IGF1R antibody
GSWDASLNGYV

SEQ ID NO: 135 - protein, 11 aa, Artificial Sequence
  VL CDR3 of anti-IGF1R antibody
GAWDDSLNGYV

SEQ ID NO: 136 - protein, 11 aa, Artificial Sequence
  VL CDR3 of anti-IGF1R antibody
GAWDDSLHGYV

SEQ ID NO: 137 - protein, 11 aa, Artificial Sequence
  VL CDR3 of anti-IGF1R antibody
AAWDDSLNAYV

SEQ ID NO: 138 - protein, 11 aa, Artificial Sequence
  VL CDR3 of anti-IGF1R antibody
GTWDDSLNGYV

SEQ ID NO: 139 - protein, 11 aa, Artificial Sequence
  VL CDR3 of anti-IGF1R antibody
GTWDDSLNAYV

SEQ ID NO: 140 - protein, 11 aa, Artificial Sequence
  VL CDR3 of anti-IGF1R antibody
GSWDDSLNGYV

SEQ ID NO: 141 - protein, 11 aa, Artificial Sequence
  VL CDR3 of anti-IGF1R antibody
GSWDSSLNGYV

SEQ ID NO: 142 - protein, 11 aa, Artificial Sequence
  VL CDR3 of anti-IGF1R antibody
GTWDYSLSGYV

SEQ ID NO: 143 - protein, 11 aa, Artificial Sequence
  VL CDR3 of anti-IGF1R antibody
ATWDASLNGYV

SEQ ID NO: 144 - protein, 11 aa, Artificial Sequence
  VL CDR3 of anti-IGF1R antibody
GAWDYSLSGYV

SEQ ID NO: 145 - protein, 11 aa, Artificial Sequence
  VL CDR3 of anti-IGF1R antibody
GSWDASLNAYV

SEQ ID NO: 146 - protein, 11 aa, Artificial Sequence
  VL CDR3 of anti-IGF1R antibody
GAWDYSLSAYV

SEQ ID NO: 147 - protein, 11 aa, Artificial Sequence
  VL CDR3 of anti-IGF1R antibody
GAWDASLNGYV

SEQ ID NO: 148 - protein, 11 aa, Artificial Sequence
  VL CDR3 of anti-IGF1R antibody
ASWDDSLNAYV

SEQ ID NO: 149 - protein, 11 aa, Artificial Sequence
  VL CDR3 of anti-IGF1R antibody
GAWEQWLNGYV

SEQ ID NO: 150 - protein, 11 aa, Artificial Sequence
  VL CDR3 of anti-IGF1R antibody
GAWEQWLHGYV

SEQ ID NO: 151 - protein, 11 aa, Artificial Sequence
  VL CDR3 of anti-IGF1R antibody
GTWAGSLNGYV

SEQ ID NO: 152 - protein, 11 aa, Artificial Sequence
  VL CDR3 of anti-IGF1R antibody
GTWAGSLHGYV

SEQ ID NO: 153 - protein, 11 aa, Artificial Sequence
  VL CDR3 of anti-IGF1R antibody
GAWDTTLNGYV

SEQ ID NO: 154 - protein, 11 aa, Artificial Sequence
  VL CDR3 of anti-IGF1R antibody
GAWEESLNGYV

SEQ ID NO: 155 - protein, 11 aa, Artificial Sequence
  VL CDR3 of anti-IGF1R antibody
GSWDVSLNGYV

SEQ ID NO: 156 - protein, 11 aa, Artificial Sequence
  VL CDR3 of anti-IGF1R antibody
GAWDHSLNGYV

SEQ ID NO: 157 - protein, 11 aa, Artificial Sequence
  VL CDR3 of anti-IGF1R antibody
GAWDQSLNGYV

SEQ ID NO: 158 - protein, 12 aa, Artificial Sequence
  VL CDR3 of anti-IGF1R antibody
GASWDEWLNGYV

SEQ ID NO: 159 - protein, 11 aa, Artificial Sequence
  VL CDR3 of anti-IGF1R antibody
GAWDETLNGYV

SEQ ID NO: 160 - protein, 11 aa, Artificial Sequence
  VL CDR3 of anti-IGF1R antibody
GAWDDSLDGYV

SEQ ID NO: 161 - protein, 11 aa, Artificial Sequence
  VL CDR3 of anti-IGF1R antibody
GAWDDSLKGYV

SEQ ID NO: 162 - protein, 22 aa, Artificial Sequence
  L-FR1 of anti-IGF1R antibody
QSVLTQPPSASGTPGQRVTISC

SEQ ID NO: 163 - protein, 22 aa, Artificial Sequence
  L-FR1 of anti-IGF1R antibody
QSVLTQPPSASGTPGQRATISC

SEQ ID NO: 164 - protein, 22 aa, Artificial Sequence
  L-FR1 of anti-IGF1R antibody
QSVLTQPPSASGPPGQRVTISC

SEQ ID NO: 165 - protein, 15 aa, Artificial Sequence
  L-FR2 of anti-IGF1R antibody
WYQQLPGTAPKLLIY

SEQ ID NO: 166 - protein, 32 aa, Artificial Sequence
  L-FR3 of anti-IGF1R antibody
GVPDRFSGSKSGTSASLAISGLRSEDEADYYC

SEQ ID NO: 167 - protein, 32 aa, Artificial Sequence
  L-FR3 of anti-IGF1R antibody
GVSDRFSGSKSGTSASLAISGLRSEDEADYYC

SEQ ID NO: 168 - protein, 32 aa, Artificial Sequence
  L-FR3 of anti-IGF1R antibody
GVPDRFSGSKSGTSASLAISGLRSEDGADYYC

SEQ ID NO: 169 - protein, 10 aa, Artificial Sequence
  L-FR4 of anti-IGF1R antibody
FGGGTKLTVL

SEQ ID NO: 170 - protein, 10 aa, Artificial Sequence
  L-FR4 of anti-IGF1R antibody
FGCGTKLTVL

SEQ ID NO: 171 - protein, 10 aa, Artificial Sequence
  L-FR4 of anti-IGF1R antibody
FGGGTKLTFL

SEQ ID NO: 172 - protein, 127 aa, Artificial Sequence
  heavy chain variable region of anti-IGF1R antibody
EVQLLESGGGLVQPGGSLRLSCAASGFTFSSYDMSWVRQAPGKGLEWVSGIYHDGSSTYYADSVKGRFTISRDNSKNTLYLQMNSLRAEDTAVYYCAKVSGTLSEPYAFFFNAMDVWGQGTLVTVSS

SEQ ID NO: 173 - protein, 127 aa, Artificial Sequence
  heavy chain variable region of anti-IGF1R antibody
EVQLLESGGGLVQPGGSLRLSCAASGFTFSSYDMSWVRQAPGKCLEWVSGIYHDGSSTYYADSVKGRFTISRDNSKNTLYLQMNSLRAEDTAVYYCAKVSGTLSEPYAFFFNAMDVWGQGTLVTVSS

SEQ ID NO: 174 - protein, 121 aa, Artificial Sequence
  heavy chain variable region of anti-IGF1R antibody
EVQLLESGGGLVQPGGSLRLSCAASGFTFSNYDMSWVRQAPGKGLEWVSSISPDGGSKYYADSVKGRFTISRDNSKNTLYLQMNSLRAEDTAVYYCAKDGGTHWLSLFDYWGQGTLVTVSS

SEQ ID NO: 175 - protein, 121 aa, Artificial Sequence
  heavy chain variable region of anti-IGF1R antibody
EVQLLESGGGLVQPGGSLRLSCAASGFTFSNYDMSWVRQAPGKCLEWVSSISPDGGSKYYADSVKGRFTISRDNSKNTLYLQMNSLRAEDTAVYYCAKDGGTHWLSLFDYWGQGTLVTVSS

SEQ ID NO: 176 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYDNGNTYYADSVKGRFTISRDNSKNTLYLQMNSLRAEDTAVYYCAKGVLTTLMNWFDYWGQGTLVTVSS

SEQ ID NO: 177 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 178 - protein, 121 aa, Artificial Sequence; identical to SEQ ID NO: 177
  heavy chain variable region of anti-IGF1R antibody

SEQ ID NO: 179 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 180 - protein, 121 aa, Artificial Sequence; identical to SEQ ID NO: 179
  heavy chain variable region of anti-IGF1R antibody

SEQ ID NO: 181 - protein, 127 aa, Artificial Sequence
  heavy chain variable region of anti-IGF1R antibody
EVQLLESGGGLVQPGGSLRLSCAASGFTFSDYDMSWVRQAPGKGLEWVSSIYPNGSSKYYADSVKGRFTISRDNSKNTLYLQMNSLRAEDTAVYYCAKAGINCTTLRCSSYDAMDVWGQGTLVTVSS

SEQ ID NO: 182 - protein, 127 aa, Artificial Sequence
  heavy chain variable region of anti-IGF1R antibody
EVQLLESGGGLVQPGGSLRLSCAASGFTFSDYDMSWVRQAPGKCLEWVSSIYPNGSSKYYADSVKGRFTISRDNSKNTLYLQMNSLRAEDTAVYYCAKAGINCTTLRCSSYDAMDVWGQGTLVTVSS

SEQ ID NO: 183 - protein, 127 aa, Artificial Sequence
  heavy chain variable region of anti-IGF1R antibody
EVQLLESGGGLVQPGGSLRLSCAASGFTFSSYDMSWVRQAPGKGLEWVSGISYSGGSTYYADSVKGRFTISRDNSKNTLYLQMNSLRAEDTAVYYCAKVGLACTPHTCSSYDAMDVWGQGTLVTVSS

SEQ ID NO: 184 - protein, 127 aa, Artificial Sequence
  heavy chain variable region of anti-IGF1R antibody
EVQLLESGGGLVQPGGSLRLSCAASGFTFSSYDMSWVRQAPGKCLEWVSGISYSGGSTYYADSVKGRFTISRDNSKNTLYLQMNSLRAEDTAVYYCAKVGLACTPHTCSSYDAMDVWGQGTLVTVSS

SEQ ID NO: 185 - protein, 127 aa, Artificial Sequence
  heavy chain variable region of anti-IGF1R antibody
EVQLLESGGGLVQPGGSLRLSCAASGFTFSDYDMSWVRQAPGKGLEWVSAISSDGSSAYYADSVKGRFTISRDNSKNTLYLQMNSLRAEDTAVYYCAKATIYTSDAPWSSYDAMDVWGQGTLVTVSS

SEQ ID NO: 186 - protein, 127 aa, Artificial Sequence
  heavy chain variable region of anti-IGF1R antibody
EVQLLESGGGLVQPGGSLRLSCAASGFTFSDYDMSWVRQAPGKCLEWVSAISSDGSSAYYADSVKGRFTISRDNSKNTLYLQMNSLRAEDTAVYYCAKATIYTSDAPWSSYDAMDVWGQGTLVTVSS

SEQ ID NO: 187 - protein, 127 aa, Artificial Sequence
  heavy chain variable region of anti-IGF1R antibody
EVQLLESGGGLVQPGGSLRLSCAASGFTFSNYDMSWVRQAPGKGLEWVSVISHSSSGTYYADSVKGRFTISRDNSKNTLYLQMNSLRAEDTAVYYCAKVGVACGETDCSSYDAMDVWGQGTLVTVSS

SEQ ID NO: 188 - protein, 127 aa, Artificial Sequence
  heavy chain variable region of anti-IGF1R antibody
EVQLLESGGGLVQPGGSLRLSCAASGFTFSNYDMSWVRQAPGKCLEWVSVISHSSSGTYYADSVKGRFTISRDNSKNTLYLQMNSLRAEDTAVYYCAKVGVACGETDCSSYDAMDVWGQGTLVTVSS

SEQ ID NO: 189 - protein, 127 aa, Artificial Sequence
  heavy chain variable region of anti-IGF1R antibody
EVQLLESGGGLVQPGGSLRLSCAASGFTFSDYDMSWVRQAPGKGLEWVSMIYSGSSSKYYADSVKGRFTISRDNSKNTLYLQMNSLRAEDTAVYYCAKASIACTLQACSYDNAMDVWGQGTLVTVSS

SEQ ID NO: 190 - protein, 127 aa, Artificial Sequence
  heavy chain variable region of anti-IGF1R antibody
EVQLLESGGGLVQPGGSLRLSCAASGFTFSDYDMSWVRQAPGKCLEWVSMIYSGSSSKYYADSVKGRFTISRDNSKNTLYLQMNSLRAEDTAVYYCAKASIACTLQACSYDNAMDVWGQGTLVTVSS

SEQ ID NO: 191 - protein, 127 aa, Artificial Sequence; identical to SEQ ID NO: 190
  heavy chain variable region of anti-IGF1R antibody

SEQ ID NO: 192 - protein, 127 aa, Artificial Sequence
  heavy chain variable region of anti-IGF1R antibody
EVQLLESGGGLVQPGGSLRLSCAASGFTFSSYDMSWVRQAPGKGLEWVSAIYHDGGNTYYADSVKGRFTISRDNSKNTLYLQMNSLRAEDTAVYYCAKAASPCNVHDCSYDYAMDVWGQGTLVTVSS

SEQ ID NO: 193 - protein, 127 aa, Artificial Sequence
  heavy chain variable region of anti-IGF1R antibody
EVQLLESGGGLVQTGGSLRLSCAASGFTFSDYDMSWVRQAPGKGLEWVSGISYNGGSKYYADSVKGRFTISRDNSKNTLYLQMNSLRAEDTAVYYCAKVGIMCSETGCSYDNAMDVWGQGTLVTVSS

SEQ ID NO: 194 - protein, 127 aa, Artificial Sequence
  heavy chain variable region of anti-IGF1R antibody
EVQLLESGGGLVQPGGSLRLSCAASGFTFSDYYMSWVRQAPGKGLEWVSGISSDGGSIYYADSVKGRFTISRDNSKNTLYLQMNSLRAEDTAVYYCAKYASPTWLHILYYSDAMDVWGQGTLVTVSS

SEQ ID NO: 195 - protein, 127 aa, Artificial Sequence
  heavy chain variable region of anti-IGF1R antibody
EVQLLESGGGLVQPGGSLRLSCAASGFTFSNYDMSWVRQAPGKGLEWVSMIYSGSSSKYYADSVKGRFTISRDNSKNTLYLQMNSLRAEDTAVYYCARALIPCTPEGCYSYDAMDVWGQGTLVTVSS

SEQ ID NO: 196 - protein, 121 aa, Artificial Sequence
  heavy chain variable region of anti-IGF1R antibody
EVQLLESGGGLAQPGGSLRLSCAASGFTFSGYAMSWVRQAPGKGLEWVSAISSDGGSTYYADSVKGRFTISRDNSKNTLYLQMNSLRAEDTAVYYCARDPWFSRWTAFDYWGQGTLVTVSS

SEQ ID NO: 197 - protein, 127 aa, Artificial Sequence
  heavy chain variable region of anti-IGF1R antibody
EVQLLESGGGLVQPGGSLRLSCAASGFTFSDYDMSWVRQAPGKGLEWVSGIYPDGGNIYYADSVKGRFTISRDNSKNTLYLQMNSLRAEDTAVYYCARGIGQCELRECSSDDGMDVWGQGTLVTVSS

SEQ ID NO: 198 - protein, 127 aa, Artificial Sequence
  heavy chain variable region of anti-IGF1R antibody
EVQLLESGGGLVQPGGSLRLSCAASGFTFSDYDMSWVRQAPGKGLEWVSAIYYDSGSIYYADSVKGRFTISRDNSKNTLYLQMNSLRAEDTAVYYCAKAVSECNPLNCSYSDAMDVWGQGTLVTVSS

SEQ ID NO: 199 - protein, 127 aa, Artificial Sequence
  heavy chain variable region of anti-IGF1R antibody
EVQLLESGGGLVQPGGSLRLSCAASGFTFSDYDMSWVRQAPGKGLEWVSMIYSGSSSKYYADSVKGRFTISRDNSKNTLYLQMNSLRAEDTAVYYCAKVILGCSKHSCPSSDAMDVWGQGTLVTVSS

SEQ ID NO: 200 - protein, 127 aa, Artificial Sequence
  heavy chain variable region of anti-IGF1R antibody
EVQLLESGGGLVQPGGSLRLSCAASGFTFSDYDMSWVRQAPGKGLEWVSAISYDNGNKYYADSVKGRFTISRDNSKNTLYLQMNSLRAEDTAVYYCAKAGVACTEHMCSSYDAMDVWGQGTLVTVSS

SEQ ID NO: 201 - protein, 127 aa, Artificial Sequence
  heavy chain variable region of anti-IGF1R antibody
EVQLLESGGGLVQPGGSLRLSCAASGFTFSSYDMSWVRQAPGKGLEWVSLIYPGGGNIYYADSVKGRFTISRDNSKNTLYLQMNSLRAEDTAVYYCARGRVPCHPGGCSYAYGMDVWGQGTLVTVSS

SEQ ID NO: 202 - protein, 127 aa, Artificial Sequence
  heavy chain variable region of anti-IGF1R antibody
EVQLLESGGGLVQPGGSLRLSCAASGFTFSNYAMSWVRQAPGKGLEWVSWISSGGGSTYYADSVKGRFTISRDNSKNTLYLQMNSLRAEDTAVYYCAKLGSLFPNATASYAYGMDVWGQGTLVTVSS

SEQ ID NO: 203 - protein, 127 aa, Artificial Sequence
  heavy chain variable region of anti-IGF1R antibody
EVQLLESGGGLVQPGGSLRLSCAASGFTFSNYDMSWVRQAPGKGLEWVSSISYDSGSKYYADSVKGRFTISRDNSKNTLYLQMNSLRAEDTAVYYCAKAGILCTPTHCSSYDAMDVWGQGTLVTVSS

SEQ ID NO: 204 - protein, 121 aa, Artificial Sequence
  heavy chain variable region of anti-IGF1R antibody
EVQLLESGGGLVQTGGSLRLSCAASGFTFSDYAMSWVRQAPGKGLEWVSSIYPDDGNTYYADSVKGRFTISRDNSKNTLYLQMNSLRAEDTAVYYCAKDGWTPDGTHFDYWGQGTLVTVSS

SEQ ID NO: 205 - protein, 127 aa, Artificial Sequence
  heavy chain variable region of anti-IGF1R antibody
EVQLLESGGGLVQPGGSLRLSCAASGFTFSDYDMSWVRQAPGKGLEWVSWISHSSSGTYYADSVKGRFTISRDNSKNTLYLQMNSLRAEDAAVYYCAKVGLSCAETACSSYDAMDVWGQGTLVTVSS

SEQ ID NO: 206 - protein, 127 aa, Artificial Sequence
  heavy chain variable region of anti-IGF1R antibody
EVQLLESGGGLVQPGGSLRLSCAASGFTFSSYDMSWVRQAPGKGLEWVSAISYDNGNTYYADSVKGRFTISRDNSKNTLYLQMNSLRAEDTAVYYCARVGLDCDTTKCSSYDAMDVWGQGTLVTVSS

SEQ ID NO: 207 - protein, 127 aa, Artificial Sequence
  heavy chain variable region of anti-IGF1R antibody
EVQLLESGGGLVQPGGSLRLSCAASGFTFSNYDMSWVRQAPGKGLEWVSVISHSSSGTYYADSVKGRFTISRDNPKNTLYLQMNSLRAEDTAVYYCAKVGVACGETDCSSYDAMDVWGQGTLVTVSS

SEQ ID NO: 208 - protein, 127 aa, Artificial Sequence; identical to SEQ ID NO: 205
  heavy chain variable region of anti-IGF1R antibody

SEQ ID NO: 209 - protein, 127 aa, Artificial Sequence
  heavy chain variable region of anti-IGF1R antibody
EVQLLESGGGLVQPGGSLRLSCAASGFTFSDYDMSWVRQAPGKGLEWVSMIYSGSSSKYYADSVKGRFTISRDNSKNTLYLQMNSLRAEDTAVYYCAKAVRPCTDLHCSSDDAMDVWGQGTLVTVSS

SEQ ID NO: 210 - protein, 127 aa, Artificial Sequence
  heavy chain variable region of anti-IGF1R antibody
EVQLLESGGGLVQPGGSLRLSCAASGFTFSDYDMSWVRQAPGKGLEWVSAISYDSGSKYYADSVKGRFTISRDNSKNTLYLQMNSLRAEDTAVYYCAKVGRMCNITHCSSYDAMDVWGQGTLVTVSS

SEQ ID NO: 211 - protein, 121 aa, Artificial Sequence
  heavy chain variable region of anti-IGF1R antibody
EVQLLESGGGLVQPGGSLRLSCAASGFTFSDYDMSWVRQAPGKGLEWVSSIYYGSGNIYYADSVKGRFTISRDNSKNTLYLQMNSLRAEDTAVYYCAKDLTAPDGSSFDYWGQGTQVTVSS

SEQ ID NO: 212 - protein, 128 aa, Artificial Sequence
  heavy chain variable region of anti-IGF1R antibody
EVQLLESGGGLVQPGGSLRLSCAASGFTFSSYDMSWVRQAPGKGLEWVSAISYDNGSSIYYADSVKGRFTISRDNSKNTLYLQMNSLRAEDTAVYYCAKVGLECTVEHCYSYDGMDVWGQGTLVTVSS

SEQ ID NO: 213 - protein, 121 aa, Artificial Sequence; identical to SEQ ID NO: 176
  heavy chain variable region of anti-IGF1R antibody

SEQ ID NO: 214 - protein, 120 aa, Artificial Sequence
  heavy chain variable region of anti-IGF1R antibody
EVQLLESGGGLVQPGGSLRLSCAASGFTFSSYDMSWVRQAPGKLEWVSAISYDNGNTYYADSVKGRFTISRDNSKNTLYLQMNSLRAEDTAVYYCAKGVLTTLMNWFDYWGQGTLVTVSS

SEQ ID NO: 215 - protein, 120 aa, Artificial Sequence; identical to SEQ ID NO: 214
  heavy chain variable region of anti-IGF1R antibody

SEQ ID NO: 216 - protein, 121 aa, Artificial Sequence; identical to SEQ ID NO: 179
  heavy chain variable region of anti-IGF1R antibody

SEQ ID NO: 217 - protein, 121 aa, Artificial Sequence; identical to SEQ ID NO: 179
  heavy chain variable region of anti-IGF1R antibody

SEQ ID NO: 218 - protein, 121 aa, Artificial Sequence; identical to SEQ ID NO: 176
  heavy chain variable region of anti-IGF1R antibody

SEQ ID NO: 219 - protein, 121 aa, Artificial Sequence; identical to SEQ ID NO: 177
  heavy chain variable region of anti-IGF1R antibody

SEQ ID NO: 220 - protein, 121 aa, Artificial Sequence; identical to SEQ ID NO: 177
  heavy chain variable region of anti-IGF1R antibody

SEQ ID NO: 221 - protein, 121 aa, Artificial Sequence; identical to SEQ ID NO: 179
  heavy chain variable region of anti-IGF1R antibody

SEQ ID NO: 222 - protein, 121 aa, Artificial Sequence; identical to SEQ ID NO: 179
  heavy chain variable region of anti-IGF1R antibody

SEQ ID NO: 223 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISWDKAQPYYADSVKGRFTISRDNSKNTLYLQMNSLRAEDTAVYYCAKGVLTTLMNWFDYWGQGTLVTVSS

SEQ ID NO: 224 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISWDQGNSYYADSVKGRFTISRDNSKNTLYLQMNSLRAEDTAVYYCAKGVLTTLMNWFDYWGQGTLVTVSS

SEQ ID NO: 225 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISWGQGKTYYADSVKGRFTISRDNSKNTLYLQMNSLRAEDTAVYYCAKGVLTTLMNWFDYWGQGTLVTVSS

SEQ ID NO: 226 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYDNGQTYYADSVKGRFTISRDNSKNTLYLQMNSLRAEDTAVYYCAKGVLTTLMNWFDYWGQGTLVTVSS

SEQ ID NO: 227 - protein, 121 aa, Artificial Sequence; identical to SEQ ID NO: 176
  heavy chain variable region of anti-IGF1R antibody

SEQ ID NO: 228 - protein, 121 aa, Artificial Sequence; identical to SEQ ID NO: 176
  heavy chain variable region of anti-IGF1R antibody

SEQ ID NO: 229 - protein, 121 aa, Artificial Sequence; identical to SEQ ID NO: 176
  heavy chain variable region of anti-IGF1R antibody

SEQ ID NO: 230 - protein, 121 aa, Artificial Sequence; identical to SEQ ID NO: 176
  heavy chain variable region of anti-IGF1R antibody

SEQ ID NO: 231 - protein, 121 aa, Artificial Sequence; identical to SEQ ID NO: 176
  heavy chain variable region of anti-IGF1R antibody

SEQ ID NO: 232 - protein, 121 aa, Artificial Sequence; identical to SEQ ID NO: 176
  heavy chain variable region of anti-IGF1R antibody

SEQ ID NO: 233 - protein, 121 aa, Artificial Sequence; identical to SEQ ID NO: 176
  heavy chain variable region of anti-IGF1R antibody

SEQ ID NO: 234 - protein, 121 aa, Artificial Sequence; identical to SEQ ID NO: 176
  heavy chain variable region of anti-IGF1R antibody

SEQ ID NO: 235 - protein, 121 aa, Artificial Sequence
  heavy chain variable region of anti-IGF1R antibody
EVQLLESGGGLVQPGGSLRLSCAASGFTFSSYAMSWVRQAPGKGLEWVSAISGSNGNTYYADSVKGRFTISRDNSKNTLYLQMNSLRAEDTAVYYCAKGVLTTLANWFDYWGQGTLVTVSS

SEQ ID NO: 236 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISGSNGNTYYADSVKGRFTISRDNSKNTLYLQMNSLRAEDTAVYYCAKGVLTTLANWFDYWGQGTLVTVSS

SEQ ID NO: 237 - protein, 121 aa, Artificial Sequence; identical to SEQ ID NO: 236
  heavy chain variable region of anti-IGF1R antibody

SEQ ID NO: 238 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISGSQGNTYYADSVKGRFTISRDNSKNTLYLQMNSLRAEDTAVYYCAKGVLTTLANWFDYWGQGTLVTVSS

SEQ ID NO: 239 - protein, 121 aa, Artificial Sequence; identical to SEQ ID NO: 238
  heavy chain variable region of anti-IGF1R antibody

SEQ ID NO: 240 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISGDNGSTYYADSVKGRFTISRDNSKNTLYLQMNSLRAEDTAVYYCAKGVLTTLMNWFDSWGQGTLVTVSS

SEQ ID NO: 241 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISGDNGSTYYADSVKGRFTISRDNSKNTLYLQMNSLRAEDTAVYYCAKGVLTTLMNWFDSWGQGTLVTVSS

SEQ ID NO: 242 - protein, 121 aa, Artificial Sequence; identical to SEQ ID NO: 241
  heavy chain variable region of anti-IGF1R antibody

SEQ ID NO: 243 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISGDQGSTYYADSVKGRFTISRDNSKNTLYLQMNSLRAEDTAVYYCAKGVLTTLMNWFDYWGQGTLVTVSS

SEQ ID NO: 244 - protein, 121 aa, Artificial Sequence; identical to SEQ ID NO: 243
  heavy chain variable region of anti-IGF1R antibody

SEQ ID NO: 245 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYSNGNTYYADSVKGRFTISRDNSKNTLYLQMNSLRAEDTAVYYCAKGVLTTLANWFDYWGQGTLVTVSS

SEQ ID NO: 246 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISYSNGNTYYADSVKGRFTISRDNSKNTLYLQMNSLRAEDTAVYYCAKGVLTTLANWFDYWGQGTLVTVSS

SEQ ID NO: 247 - protein, 121 aa, Artificial Sequence; identical to SEQ ID NO: 246
  heavy chain variable region of anti-IGF1R antibody

SEQ ID NO: 248 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISYSQGNTYYADSVKGRFTISRDNSKNTLYLQMNSLRAEDTAVYYCAKGVLTTLANWFDYWGQGTLVTVSS

SEQ ID NO: 249 - protein, 121 aa, Artificial Sequence; identical to SEQ ID NO: 248
  heavy chain variable region of anti-IGF1R antibody

SEQ ID NO: 250 - protein, 121 aa, Artificial Sequence
  heavy chain variable region of anti-IGF1R antibody
EVQLLESGGGLVQPGGSLRLSCAASGFTFSSYAMSWVRQAPGKGLEWVSAISYDNGSTYYADSVKGRFTISRDNSKNTLYLQMNSLRAEDTAVYYCAKGVLTTLMNWFDYWGQGTLVTVSS

SEQ ID NO: 251 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISYDNGSTYYADSVKGRFTISRDNSKNTLYLQMNSLRAEDTAVYYCAKGVLTTLMNWFDYWGQGTLVTVSS

SEQ ID NO: 252 - protein, 121 aa, Artificial Sequence; identical to SEQ ID NO: 251
  heavy chain variable region of anti-IGF1R antibody

SEQ ID NO: 253 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISYDQGSTYYADSVKGRFTISRDNSKNTLYLQMNSLRAEDTAVYYCAKGVLTTLMNWFDYWGQGTLVTVSS

SEQ ID NO: 254 - protein, 121 aa, Artificial Sequence; identical to SEQ ID NO: 253
  heavy chain variable region of anti-IGF1R antibody

SEQ ID NO: 255 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISGDNGNTYYADSVKGRFTISRDNSKNTLYLQMNSLRAEDTAVYYCAKGVLTTLMNWFDYWGQGTLVTVSS

SEQ ID NO: 256 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISGDNGNTYYADSVKGRFTISRDNSKNTLYLQMNSLRAEDTAVYYCAKGVLTTLMNWFDYWGQGTLVTVSS

SEQ ID NO: 257 - protein, 121 aa, Artificial Sequence; identical to SEQ ID NO: 256
  heavy chain variable region of anti-IGF1R antibody

SEQ ID NO: 258 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISGDQGNTYYADSVKGRFTISRDNSKNTLYLQMNSLRAEDTAVYYCAKGVLTTLMNWFDYWGQGTLVTVSS

SEQ ID NO: 259 - protein, 121 aa, Artificial Sequence; identical to SEQ ID NO: 258
  heavy chain variable region of anti-IGF1R antibody

SEQ ID NO: 260 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISGSNGNTYYADSVKGRFTISRDNSKNTLYLQMNSLRAEDTAVYYCAKGVLTTLMNWFDYWGQGTLVTVSS

SEQ ID NO: 261 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISGSNGNTYYADSVKGRFTISRDNSKNTLYLQMNSLRAEDTAVYYCAKGVLTTLMNWFDYWGQGTLVTVSS

SEQ ID NO: 262 - protein, 121 aa, Artificial Sequence; identical to SEQ ID NO: 261
  heavy chain variable region of anti-IGF1R antibody

SEQ ID NO: 263 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISGSQGNTYYADSVKGRFTISRDNSKNTLYLQMNSLRAEDTAVYYCAKGVLTTLMNWFDYWGQGTLVTVSS

SEQ ID NO: 264 - protein, 121 aa, Artificial Sequence; identical to SEQ ID NO: 263
  heavy chain variable region of anti-IGF1R antibody

SEQ ID NO: 265 - protein, 121 aa, Artificial Sequence
  heavy chain variable region of anti-IGF1R antibody
EVQLLESGGGLVQPGGSLRLSCAASGFTFSSYAMSWVRQAPGKGLEWVSAISYDNGSTYYADSVKGRFTISRDNSKNTLYLQMNSLRAEDTAVYYCAKGVLTTLMNWFDSWGQGTLVTVSS

SEQ ID NO: 266 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISYDNGSTYYADSVKGRFTISRDNSKNTLYLQMNSLRAEDTAVYYCAKGVLTTLMNWFDSWGQGTLVTVSS

SEQ ID NO: 267 - protein, 121 aa, Artificial Sequence; identical to SEQ ID NO: 266
  heavy chain variable region of anti-IGF1R antibody

SEQ ID NO: 268 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISYDQGSTYYADSVKGRFTISRDNSKNTLYLQMNSLRAEDTAVYYCAKGVLTTLMNWFDSWGQGTLVTVSS

SEQ ID NO: 269 - protein, 121 aa, Artificial Sequence; identical to SEQ ID NO: 268
  heavy chain variable region of anti-IGF1R antibody

SEQ ID NO: 270 - protein, 121 aa, Artificial Sequence
  heavy chain variable region of anti-IGF1R antibody
EVQLLESGGGLVQPGGSLRLSCAASGFTFSSYAMSWVRQAPGKGLEWVSAISYDNGNTYYADSVKGRFTISRDNSKNTLYLQMNSLRAEDTAVYYCAKGVLTTLANWFDYWGQGTLVTVSS

SEQ ID NO: 271 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISYDNGNTYYADSVKGRFTISRDNSKNTLYLQMNSLRAEDTAVYYCAKGVLTTLANWFDYWGQGTLVTVSS

SEQ ID NO: 272 - protein, 121 aa, Artificial Sequence; identical to SEQ ID NO: 271
  heavy chain variable region of anti-IGF1R antibody

SEQ ID NO: 273 - protein, 121 aa, Artificial Sequence
  heavy chain variable region of anti-IGF1R antibody
EVQLLESGGGLVQPGGSLRLSCAASGFTFSSYAMSWVRQAPGKCLEWVSAISYDQGNTYYADSVKGRFTISRDNSKNTLYLQMNSLRAEDTAVYYCAKGVLTTLANWFDYWGQGTLVTVSS

SEQ ID NO: 274 - protein, 121 aa, Artificial Sequence; identical to SEQ ID NO: 273
  heavy chain variable region of anti-IGF1R antibody

SEQ ID NO: 275 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYDNGSTYYADSVKGRFTISRDNSKNTLYLQMNSLRAEDTAVYYCAKGVLTTLMNWFDSWGQGTLVTVSS

SEQ ID NO: 276 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISYDNGSTYYADSVKGRFTISRDNSKNTLYLQMNSLRAEDTAVYYCAKGVLTTLMNWFDSWGQGTLVTVSS

SEQ ID NO: 277 - protein, 121 aa, Artificial Sequence; identical to SEQ ID NO: 276
  heavy chain variable region of anti-IGF1R antibody

SEQ ID NO: 278 - protein, 121 aa, Artificial Sequence
  heavy chain variable region of anti-IGF1R antibody
EVQLLESGGGLVQPGGSLRLSCAASGFTFSSYDMSWVRQAPGKCLEWVSAISYDQGSTYYADSVKGRFTISRDNSKNTLYLQMNSLRAEDTAVYYCAKGVLTTLMNWFDSWGQGTLVTVSS

SEQ ID NO: 279 - protein, 121 aa, Artificial Sequence; identical to SEQ ID NO: 278
  heavy chain variable region of anti-IGF1R antibody

SEQ ID NO: 280 - protein, 121 aa, Artificial Sequence
  heavy chain variable region of anti-IGF1R antibody
EVQLLESGGGLVQPGGSLRLSCAASGFTFSSYAMSWVRQAPGKGLEWVSAISGSNGNTYYADSVKGRFTISRDNSKNTLYLQMNSLRAEDTAVYYCAKGVLTTLANWFDSWGQGTLVTVSS

SEQ ID NO: 281 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYDNGNTYYADSVKGRFTISRDNSKNTLYLQMNSLRAEDTAVYYCAKGVLTTLANWFDYWGQGTLVTVSS

SEQ ID NO: 282 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISGSNGSTYYADSVKGRFTISRDNSKNTLYLQMNSLRAEDTAVYYCAKGVLTTLMNWFDYWGQGTLVTVSS

SEQ ID NO: 283 - protein, 121 aa, Artificial Sequence
  heavy chain variable region of anti-IGF1R antibody
EVQLLESGGGLVQPGGSLRRSCAASGFTFICPILSWVRQAPGKGLEWVSAISYDNGNTYYADSVKGRFTISRDNSKNTLYLQMNSLRAEDTAVYYCAKGVLTTLMCLRHLWGQGSLVTVSS

SEQ ID NO: 284 - protein, 121 aa, Artificial Sequence; identical to SEQ ID NO: 176
  heavy chain variable region of anti-IGF1R antibody

SEQ ID NO: 285 - protein, 121 aa, Artificial Sequence; identical to SEQ ID NO: 176
  heavy chain variable region of anti-IGF1R antibody

SEQ ID NO: 286 - protein, 121 aa, Artificial Sequence; identical to SEQ ID NO: 176
  heavy chain variable region of anti-IGF1R antibody

SEQ ID NO: 287 - protein, 121 aa, Artificial Sequence; identical to SEQ ID NO: 176
  heavy chain variable region of anti-IGF1R antibody

SEQ ID NO: 288 - protein, 121 aa, Artificial Sequence; identical to SEQ ID NO: 176
  heavy chain variable region of anti-IGF1R antibody

SEQ ID NO: 289 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYDDGNTYYADSVKGRFTISRDNSKNTLYLQMNSLRAEDTAVYYCAKGVLTTLMNWFDYWGQGTLVTVSS

SEQ ID NO: 290 - protein, 121 aa, Artificial Sequence
  heavy chain variable region of anti-IGF1R antibody
EVQLLESGGGLVQPGGSLRLSCAASGFTFSSYDMSWVRQAPGKGLEWVSAISYDQGNTYYADSVKGRFTISRDNSKNTLYLQMNSLRAEDTAVYYCAKGVLTTLMNWFDYWGQGTLVTVSS

SEQ ID NO: 291 - protein, 110 aa, Artificial Sequence
  light chain variable region of anti-IGF1R antibody
QSVLTQPPSASGTPGQRVTISCTGSSSNIGSNAVNWYQQLPGTAPKLLIYSNSHRPSGVPDRFSGSKSGTSASLAISGLRSEDEADYYCATWDYSLSGYVFGGGTKLTVL

SEQ ID NO: 292 - protein, 110 aa, Artificial Sequence
  light chain variable region of anti-IGF1R antibody
QSVLTQPPSASGTPGQRVTISCTGSSSNIGSNAVNWYQQLPGTAPKLLIYSNSHRPSGVPDRFSGSKSGTSASLAISGLRSEDEADYYCATWDYSLSGYVFGCGTKLTVL

SEQ ID NO: 293 - protein, 110 aa, Artificial Sequence
  light chain variable region of anti-IGF1R antibody
QSVLTQPPSASGTPGQRVTISCTGSSSNIGNNTVSWYQQLPGTAPKLLIYYDNHRPSGVPDRFSGSKSGTSASLAISGLRSEDEADYYCGSWDASLNGYVFGGGTKLTVL

SEQ ID NO: 294 - protein, 110 aa, Artificial Sequence
  light chain variable region of anti-IGF1R antibody
QSVLTQPPSASGTPGQRVTISCTGSSSNIGNNTVSWYQQLPGTAPKLLIYYDNHRPSGVPDRFSGSKSGTSASLAISGLRSEDEADYYCGSWDASLNGYVFGCGTKLTVL

SEQ ID NO: 295 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGGGTKLTVL

SEQ ID NO: 296 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVL

SEQ ID NO: 297 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVL

SEQ ID NO: 298 - protein, 110 aa, Artificial Sequence
  light chain variable region of anti-IGF1R antibody
QSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVL

SEQ ID NO: 299 - protein, 110 aa, Artificial Sequence
  light chain variable region of anti-IGF1R antibody
QSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVL

SEQ ID NO: 300 - protein, 110 aa, Artificial Sequence
  light chain variable region of anti-IGF1R antibody
QSVLTQPPSASGTPGQRVTISCSGSSSNIGNNDVSWYQQLPGTAPKLLIYDNNHRPSGVPDRFSGSKSGTSASLAISGLRSEDEADYYCAAWDDSLNAYVFGGGTKLTVL

SEQ ID NO: 301 - protein, 110 aa, Artificial Sequence
  light chain variable region of anti-IGF1R antibody
QSVLTQPPSASGTPGQRVTISCSGSSSNIGNNDVSWYQQLPGTAPKLLIYDNNHRPSGVPDRFSGSKSGTSASLAISGLRSEDEADYYCAAWDDSLNAYVFGCGTKLTVL

SEQ ID NO: 302 - protein, 110 aa, Artificial Sequence
  light chain variable region of anti-IGF1R antibody
QSVLTQPPSASGTPGQRVTISCTGSSSNIGSNTVYWYQQLPGTAPKLLIYSDSNRPSGVPDRFSGSKSGTSASLAISGLRSEDEADYYCGTWDDSLNGYVFGGGTKLTVL

SEQ ID NO: 303 - protein, 110 aa, Artificial Sequence
  light chain variable region of anti-IGF1R antibody
QSVLTQPPSASGTPGQRVTISCTGSSSNIGSNTVYWYQQLPGTAPKLLIYSDSNRPSGVPDRFSGSKSGTSASLAISGLRSEDEADYYCGTWDDSLNGYVFGCGTKLTVL

SEQ ID NO: 304 - protein, 110 aa, Artificial Sequence
  light chain variable region of anti-IGF1R antibody
QSVLTQPPSASGTPGQRVTISCSGSSSNIGSNTVTWYQQLPGTAPKLLIYADSKRPSGVPDRFSGSKSGTSASLAISGLRSEDEADYYCGTWDDSLNAYVFGGGTKLTVL

SEQ ID NO: 305 - protein, 110 aa, Artificial Sequence
  light chain variable region of anti-IGF1R antibody
QSVLTQPPSASGTPGQRVTISCSGSSSNIGSNTVTWYQQLPGTAPKLLIYADSKRPSGVPDRFSGSKSGTSASLAISGLRSEDEADYYCGTWDDSLNAYVFGCGTKLTVL

SEQ ID NO: 306 - protein, 110 aa, Artificial Sequence
  light chain variable region of anti-IGF1R antibody
QSVLTQPPSASGTPGQRVTISCSGSSSNIGSNAVTWYQQLPGTAPKLLIYDDNHRPSGVPDRFSGSKSGTSASLAISGLRSEDEADYYCGAWDDSLNGYVFGGGTKLTVL

SEQ ID NO: 307 - protein, 110 aa, Artificial Sequence
  light chain variable region of anti-IGF1R antibody
QSVLTQPPSASGTPGQRVTISCSGSSSNIGSNAVTWYQQLPGTAPKLLIYDDNHRPSGVPDRFSGSKSGTSASLAISGLRSEDEADYYCGAWDDSLNGYVFGCGTKLTVL

SEQ ID NO: 308 - protein, 110 aa, Artificial Sequence
  light chain variable region of anti-IGF1R antibody
QSVLTQPPSASGTPGQRVTISCTGSSSNIGNNDVSWYQQLPGTAPKLLIYANSHRPSGVPDRFSGSKSGTSASLAISGLRSEDEADYYCGSWDDSLNGYVFGGGTKLTVL

SEQ ID NO: 309 - protein, 110 aa, Artificial Sequence
  light chain variable region of anti-IGF1R antibody
QSVLTQPPSASGTPGQRVTISCTGSSSNIGNNDVSWYQQLPGTAPKLLIYANSHRPSGVSDRFSGSKSGTSASLAISGLRSEDEADYYCGSWDDSLNGYVFGCGTKLTVL

SEQ ID NO: 310 - protein, 110 aa, Artificial Sequence
  light chain variable region of anti-IGF1R antibody
QSVLTQPPSASGTPGQRVTISCTGSSSNIGNNDVSWYQQLPGTAPKLLIYANSHRPSGVPDRFSGSKSGTSASLAISGLRSEDEADYYCGSWDDSLNGYVFGCGTKLTVL

SEQ ID NO: 311 - protein, 110 aa, Artificial Sequence
  light chain variable region of anti-IGF1R antibody
QSVLTQPPSASGTPGQRATISCSGSSSNIGNNAVTWYQQLPGTAPKLLIYDDSQRPSGVPDRFSGSKSGTSASLAISGLRSEDEADYYCGSWDDSLNGYVFGGGTKLTVL

SEQ ID NO: 312 - protein, 110 aa, Artificial Sequence
  light chain variable region of anti-IGF1R antibody
QSVLTQPPSASGTPGQRVTISCSGSSSNIGNNDVDWYQQLPGTAPKLLIYYDSQRPSGVPDRFSGSKSGTSASLAISGLRSEDEADYYCGTWDDSLNAYVFGGGTKLTVL

SEQ ID NO: 313 - protein, 110 aa, Artificial Sequence
  light chain variable region of anti-IGF1R antibody
QSVLTQPPSASGTPGQRVTISCSGSSSNIGNNAVTWYQQLPGTAPKLLIYDDSHRPSGVPDRFSGSKSGTSASLAISGLRSEDEADYYCGSWDSSLNGYVFGGGTKLTVL

SEQ ID NO: 314 - protein, 110 aa, Artificial Sequence
  light chain variable region of anti-IGF1R antibody
QSVLTQPPSASGTPGQRVTISCTGSSSNIGNNDVSWYQQLPGTAPKLLIYDDSKRPSGVPDRFSGSKSGTSASLAISGLRSEDEADYYCGAWDDSLNGYVFGGGTKLTVL

SEQ ID NO: 315 - protein, 110 aa, Artificial Sequence
  light chain variable region of anti-IGF1R antibody
QSVLTQPPSASGTPGQRVTISCSGSSSNIGNNAVNWYQQLPGTAPKLLIYSNSKRPSGVPDRFSGSKSGTSASLAISGLRSEDEADYYCGTWDYSLSGYVFGGGTKLTVL

SEQ ID NO: 316 - protein, 110 aa, Artificial Sequence
  light chain variable region of anti-IGF1R antibody
QSVLTQPPSASGTPGQRVTISCTGSSSNIGNNDVNWYQQLPGTAPKLLIYSNSHRPSGVPDRFSGSKSGTSASLAISGLRSEDGADYYCGTWDDSLNGYVFGGGTKLTVL

SEQ ID NO: 317 - protein, 110 aa, Artificial Sequence
  light chain variable region of anti-IGF1R antibody
QSVLTQPPSASGPPGQRVTISCSGSSSNIGNNDVSWYQQLPGTAPKLLIYDDNQRPSGVPDRFSGSKSGTSASLAISGLRSEDEADYYCATWDASLNGYVFGGGTKLTVL

SEQ ID NO: 318 - protein, 110 aa, Artificial Sequence
  light chain variable region of anti-IGF1R antibody
QSVLTQPPSASGTPGQRVTISCSGSSSNIGNNNVTWYQQLPGTAPKLLIYDDSQRPSGVPDRFSGSKSGTSASLAISGLRSEDEADYYCGSWDDSLNGYVFGGGTKLTVL

SEQ ID NO: 319 - protein, 110 aa, Artificial Sequence
  light chain variable region of anti-IGF1R antibody
QSVLTQPPSASGTPGQRVTISCSGSSSNIGNNDVSWYQQLPGTAPKLLIYDDNHRPSGVPDRFSGSKSGTSASLAISGLRSEDEADYYCGAWDYSLSGYVFGGGTKLTVL

SEQ ID NO: 320 - protein, 110 aa, Artificial Sequence
  light chain variable region of anti-IGF1R antibody
QSVLTQPPSASGTPGQRVTISCSGSSFNIGSNDVSWYQQLPGTAPKLLIYDNSKRPSGVPDRFSGSKSGTSASLAISGLRSEDEADYYCGTWDDSLNGYVFGGGTKLTVL

SEQ ID NO: 321 - protein, 110 aa, Artificial Sequence
  light chain variable region of anti-IGF1R antibody
QSVLTQPPSASGTPGQRVTISCSGSSSNIGSNDVSWYQQLPGTAPKLLIYDNSQRPSGVPDRFSGSKSGTSASLAISGLRSEDEADYYCGSWDASLNAYVFGGGTKLTVL

SEQ ID NO: 322 - protein, 110 aa, Artificial Sequence
  light chain variable region of anti-IGF1R antibody
QSVLTQPPSASGTPGQRVTISCSGSSSNIGNNDVNWYQQLPGTAPKLLIYSNSHRPSGVPDRFSGSKSGTSASLAISGLRSEDGADYYCGTWDDSLNGYVFGGGTKLTVL

SEQ ID NO: 323 - protein, 110 aa, Artificial Sequence
  light chain variable region of anti-IGF1R antibody
QSVLTQPPSASGTPGQRVTISCSGSSSNIGNNDVSWYQQLPGTAPKLLIYSNSHRPSGVPDRFSGSKSGTSASLAISGLRSEDEADYYCGSWDASLNGYVFGGGTKLTVL

SEQ ID NO: 324 - protein, 110 aa, Artificial Sequence
  light chain variable region of anti-IGF1R antibody
QSVLTQPPSASGTPGQRVTISCSGSSSNIGSNDVSWYQQLPGTAPKLLIYDDSNRPSGVPDRFSGSKSGTSASLAISGLRSEDEADYYCGSWDDSLNGYVFGGGTKLTVL

SEQ ID NO: 325 - protein, 110 aa, Artificial Sequence
  light chain variable region of anti-IGF1R antibody
QSVLTQPPSASGTPGQRVTISCSGSSSNIGNNDVNWYQQLPGTAPKLLIYSNSHRPSGVPDRFSGSKSGTSASLAISGLRSEDEADYYCGAWDYSLSAYVFGGGTKLTVL

SEQ ID NO: 326 - protein, 110 aa, Artificial Sequence
  light chain variable region of anti-IGF1R antibody
QSVLTQPPSASGTPGQRVTISCSGSSSNIGSNAVTWYQQLPGTAPKLLIYDDNHRPSGVPDRFSGSKSGTSASLAISGLRSEDEADYYCGAWDDSLNGYVFGGGTKLTFL

SEQ ID NO: 327 - protein, 110 aa, Artificial Sequence; identical to SEQ ID NO: 324
  light chain variable region of anti-IGF1R antibody

SEQ ID NO: 328 - protein, 110 aa, Artificial Sequence; identical to SEQ ID NO: 300
  light chain variable region of anti-IGF1R antibody

SEQ ID NO: 329 - protein, 110 aa, Artificial Sequence
  light chain variable region of anti-IGF1R antibody
QSVLTQPPSASGTPGQRVTISCTGSSSNIGSNYVSWYQQLPGTAPKLLIYDDSHRPSGVSDRFSGSKSGTSASLAISGLRSEDEADYYCGAWDDSLNGYVFGGGTKLTVL

SEQ ID NO: 330 - protein, 110 aa, Artificial Sequence
  light chain variable region of anti-IGF1R antibody
QSVLTQPPSASGTPGQRVTISCTGSSSNIGNNDVSWYQQLPGTAPKLLIYSDSQRPSGVPDRFSGSKSGTSASLAISGLRSEDEADYYCGAWDASLNGYVFGGGTKLTVL

SEQ ID NO: 331 - protein, 110 aa, Artificial Sequence
  light chain variable region of anti-IGF1R antibody
QSVLTQPPSASGTPGQRVTISCTGSSSNIGSNTVNWYQQLPGTAPKLLIYDNSQRPSGVPDRFSGSKSGTSASLAISGLRSEDEADYYCASWDDSLNAYVFGGGTKLTVL

SEQ ID NO: 332 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVPDRFSGSKSGTSASLAISGLRSEDEADYYCGAWEQWLNGYVFGGGTKLTVL

SEQ ID NO: 333 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWEQWLNGYVFGCGTKLTVL

SEQ ID NO: 334 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVPDRFSGSKSGTSASLAISGLRSEDEADYYCGAWEQWLNGYVFGCGTKLTVL

SEQ ID NO: 335 - protein, 110 aa, Artificial Sequence
  light chain variable region of anti-IGF1R antibody
QSVLTQPPSASGTPGQRVTISCTGSSSNIGSNDVSWYQQLPGTAPKLLIYAQSNRPSGVSDRFSGSKSGTSASLAISGLRSEDEADYYCGAWEQWLHGYVFGCGTKLTVL

SEQ ID NO: 336 - protein, 110 aa, Artificial Sequence
  light chain variable region of anti-IGF1R antibody
QSVLTQPPSASGTPGQRVTISCTGSSSNIGSNDVSWYQQLPGTAPKLLIYAQSNRPSGVPDRFSGSKSGTSASLAISGLRSEDEADYYCGAWEQWLHGYVFGCGTKLTVL

SEQ ID NO: 337 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVPDRFSGSKSGTSASLAISGLRSEDEADYYCGTWAGSLNGYVFGGGTKLTVL

SEQ ID NO: 338 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGTWAGSLNGYVFGCGTKLTVL

SEQ ID NO: 339 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVPDRFSGSKSGTSASLAISGLRSEDEADYYCGTWAGSLNGYVFGCGTKLTVL

SEQ ID NO: 340 - protein, 110 aa, Artificial Sequence
  light chain variable region of anti-IGF1R antibody
QSVLTQPPSASGTPGQRVTISCTGSSSNIGSNDVSWYQQLPGTAPKLLIYAQSNRPSGVSDRFSGSKSGTSASLAISGLRSEDEADYYCGTWAGSLHGYVFGCGTKLTVL

SEQ ID NO: 341 - protein, 110 aa, Artificial Sequence
  light chain variable region of anti-IGF1R antibody
QSVLTQPPSASGTPGQRVTISCTGSSSNIGSNDVSWYQQLPGTAPKLLIYAQSNRPSGVPDRFSGSKSGTSASLAISGLRSEDEADYYCGTWAGSLHGYVFGCGTKLTVL

SEQ ID NO: 342 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGGGTKLTVL

SEQ ID NO: 343 - protein, 110 aa, Artificial Sequence; identical to SEQ ID NO: 342
  light chain variable region of anti-IGF1R antibody

SEQ ID NO: 344 - protein, 110 aa, Artificial Sequence; identical to SEQ ID NO: 342
  light chain variable region of anti-IGF1R antibody

SEQ ID NO: 345 - protein, 110 aa, Artificial Sequence; identical to SEQ ID NO: 342
  light chain variable region of anti-IGF1R antibody

SEQ ID NO: 346 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDTTLNGYVFGGGTKLTVL

SEQ ID NO: 347 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWEESLNGYVFGGGTKLTVL

SEQ ID NO: 348 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGSWDVSLNGYVFGGGTKLTVL

SEQ ID NO: 349 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDHSLNGYVFGGGTKLTVL

SEQ ID NO: 350 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDQSLNGYVFGGGTKLTVL

SEQ ID NO: 351 - protein, 111 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGASWDEWLNGYVFGGGTKLTVL

SEQ ID NO: 352 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDETLNGYVFGGGTKLTVL

SEQ ID NO: 353 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGTWDDSLNGYVFGGGTKLTVL

SEQ ID NO: 354 - protein, 110 aa, Artificial Sequence; identical to SEQ ID NO: 295
  light chain variable region of anti-IGF1R antibody

SEQ ID NO: 355 - protein, 110 aa, Artificial Sequence; identical to SEQ ID NO: 296
  light chain variable region of anti-IGF1R antibody

SEQ ID NO: 356 - protein, 110 aa, Artificial Sequence; identical to SEQ ID NO: 297
  light chain variable region of anti-IGF1R antibody

SEQ ID NO: 357 - protein, 110 aa, Artificial Sequence; identical to SEQ ID NO: 298
  light chain variable region of anti-IGF1R antibody

SEQ ID NO: 358 - protein, 110 aa, Artificial Sequence; identical to SEQ ID NO: 299
  light chain variable region of anti-IGF1R antibody

SEQ ID NO: 359 - protein, 110 aa, Artificial Sequence; identical to SEQ ID NO: 295
  light chain variable region of anti-IGF1R antibody

SEQ ID NO: 360 - protein, 110 aa, Artificial Sequence; identical to SEQ ID NO: 296
  light chain variable region of anti-IGF1R antibody

SEQ ID NO: 361 - protein, 110 aa, Artificial Sequence; identical to SEQ ID NO: 297
  light chain variable region of anti-IGF1R antibody

SEQ ID NO: 362 - protein, 110 aa, Artificial Sequence; identical to SEQ ID NO: 298
  light chain variable region of anti-IGF1R antibody

SEQ ID NO: 363 - protein, 110 aa, Artificial Sequence; identical to SEQ ID NO: 299
  light chain variable region of anti-IGF1R antibody

SEQ ID NO: 364 - protein, 110 aa, Artificial Sequence; identical to SEQ ID NO: 295
  light chain variable region of anti-IGF1R antibody

SEQ ID NO: 365 - protein, 110 aa, Artificial Sequence; identical to SEQ ID NO: 296
  light chain variable region of anti-IGF1R antibody

SEQ ID NO: 366 - protein, 110 aa, Artificial Sequence; identical to SEQ ID NO: 297
  light chain variable region of anti-IGF1R antibody

SEQ ID NO: 367 - protein, 110 aa, Artificial Sequence; identical to SEQ ID NO: 298
  light chain variable region of anti-IGF1R antibody

SEQ ID NO: 368 - protein, 110 aa, Artificial Sequence; identical to SEQ ID NO: 299
  light chain variable region of anti-IGF1R antibody

SEQ ID NO: 369 - protein, 110 aa, Artificial Sequence; identical to SEQ ID NO: 295
  light chain variable region of anti-IGF1R antibody

SEQ ID NO: 370 - protein, 110 aa, Artificial Sequence; identical to SEQ ID NO: 296
  light chain variable region of anti-IGF1R antibody

SEQ ID NO: 371 - protein, 110 aa, Artificial Sequence; identical to SEQ ID NO: 297
  light chain variable region of anti-IGF1R antibody

SEQ ID NO: 372 - protein, 110 aa, Artificial Sequence; identical to SEQ ID NO: 298
  light chain variable region of anti-IGF1R antibody

SEQ ID NO: 373 - protein, 110 aa, Artificial Sequence; identical to SEQ ID NO: 299
  light chain variable region of anti-IGF1R antibody

SEQ ID NO: 374 - protein, 110 aa, Artificial Sequence; identical to SEQ ID NO: 295
  light chain variable region of anti-IGF1R antibody

SEQ ID NO: 375 - protein, 110 aa, Artificial Sequence; identical to SEQ ID NO: 296
  light chain variable region of anti-IGF1R antibody

SEQ ID NO: 376 - protein, 110 aa, Artificial Sequence; identical to SEQ ID NO: 297
  light chain variable region of anti-IGF1R antibody

SEQ ID NO: 377 - protein, 110 aa, Artificial Sequence; identical to SEQ ID NO: 298
  light chain variable region of anti-IGF1R antibody

SEQ ID NO: 378 - protein, 110 aa, Artificial Sequence; identical to SEQ ID NO: 299
  light chain variable region of anti-IGF1R antibody

SEQ ID NO: 379 - protein, 110 aa, Artificial Sequence; identical to SEQ ID NO: 295
  light chain variable region of anti-IGF1R antibody

SEQ ID NO: 380 - protein, 110 aa, Artificial Sequence; identical to SEQ ID NO: 296
  light chain variable region of anti-IGF1R antibody

SEQ ID NO: 381 - protein, 110 aa, Artificial Sequence; identical to SEQ ID NO: 297
  light chain variable region of anti-IGF1R antibody

SEQ ID NO: 382 - protein, 110 aa, Artificial Sequence; identical to SEQ ID NO: 298
  light chain variable region of anti-IGF1R antibody

SEQ ID NO: 383 - protein, 110 aa, Artificial Sequence; identical to SEQ ID NO: 299
  light chain variable region of anti-IGF1R antibody

SEQ ID NO: 384 - protein, 110 aa, Artificial Sequence; identical to SEQ ID NO: 295
  light chain variable region of anti-IGF1R antibody

SEQ ID NO: 385 - protein, 110 aa, Artificial Sequence; identical to SEQ ID NO: 296
  light chain variable region of anti-IGF1R antibody

SEQ ID NO: 386 - protein, 110 aa, Artificial Sequence; identical to SEQ ID NO: 297
  light chain variable region of anti-IGF1R antibody

SEQ ID NO: 387 - protein, 110 aa, Artificial Sequence; identical to SEQ ID NO: 298
  light chain variable region of anti-IGF1R antibody

SEQ ID NO: 388 - protein, 110 aa, Artificial Sequence; identical to SEQ ID NO: 299
  light chain variable region of anti-IGF1R antibody

SEQ ID NO: 389 - protein, 110 aa, Artificial Sequence; identical to SEQ ID NO: 295
  light chain variable region of anti-IGF1R antibody

SEQ ID NO: 390 - protein, 110 aa, Artificial Sequence; identical to SEQ ID NO: 296
  light chain variable region of anti-IGF1R antibody

SEQ ID NO: 391 - protein, 110 aa, Artificial Sequence; identical to SEQ ID NO: 297
  light chain variable region of anti-IGF1R antibody

SEQ ID NO: 392 - protein, 110 aa, Artificial Sequence; identical to SEQ ID NO: 298
  light chain variable region of anti-IGF1R antibody

SEQ ID NO: 393 - protein, 110 aa, Artificial Sequence; identical to SEQ ID NO: 299
  light chain variable region of anti-IGF1R antibody

SEQ ID NO: 394 - protein, 110 aa, Artificial Sequence; identical to SEQ ID NO: 295
  light chain variable region of anti-IGF1R antibody

SEQ ID NO: 395 - protein, 110 aa, Artificial Sequence; identical to SEQ ID NO: 296
  light chain variable region of anti-IGF1R antibody

SEQ ID NO: 396 - protein, 110 aa, Artificial Sequence; identical to SEQ ID NO: 297
  light chain variable region of anti-IGF1R antibody

SEQ ID NO: 397 - protein, 110 aa, Artificial Sequence; identical to SEQ ID NO: 298
  light chain variable region of anti-IGF1R antibody

SEQ ID NO: 398 - protein, 110 aa, Artificial Sequence; identical to SEQ ID NO: 299
  light chain variable region of anti-IGF1R antibody

SEQ ID NO: 399 - protein, 110 aa, Artificial Sequence; identical to SEQ ID NO: 295
  light chain variable region of anti-IGF1R antibody

SEQ ID NO: 400 - protein, 110 aa, Artificial Sequence; identical to SEQ ID NO: 295
  light chain variable region of anti-IGF1R antibody

SEQ ID NO: 401 - protein, 110 aa, Artificial Sequence; identical to SEQ ID NO: 295
  light chain variable region of anti-IGF1R antibody

SEQ ID NO: 402 - protein, 110 aa, Artificial Sequence; identical to SEQ ID NO: 295
  light chain variable region of anti-IGF1R antibody

SEQ ID NO: 403 - protein, 110 aa, Artificial Sequence
  light chain variable region of anti-IGF1R antibody
QSVLTQPPSASGTPGQRVTISCTGSSSNIGSNDVSWYQQLPGTAPKLLIYADSNRPSGVSDRFSGSKSGTSASLAISGLRSEDEADYYCGAWDDSLNGYVFGGGTKLTVL

SEQ ID NO: 404 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLDGYVFGGGTKLTVL

SEQ ID NO: 405 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLHGYVFGGGTKLTVL

SEQ ID NO: 406 - protein, 110 aa, Artificial Sequence
  light chain variable region of anti-IGF1R antibody
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLKGYVFGGGTKLTVL

SEQ ID NO: 407 - protein, 110 aa, Artificial Sequence; identical to SEQ ID NO: 406
  light chain variable region of anti-IGF1R antibody

SEQ ID NO: 408 - protein, 110 aa, Artificial Sequence; identical to SEQ ID NO: 295
  light chain variable region of anti-IGF1R antibody

SEQ ID NO: 409 - protein, 110 aa, Artificial Sequence; identical to SEQ ID NO: 295
  light chain variable region of anti-IGF1R antibody

SEQ ID NO: 410 - protein, 1367 aa, Artificial Sequence
  human IGF1R protein
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 411 - protein, 20 aa, Artificial Sequence
  Linker
GGGGSGGGGSGGGGSGGGGS

SEQ ID NO: 412 - protein, 15 aa, Artificial Sequence
  Linker
GGGGSGGGGSGGGGS

SEQ ID NO: 413 - protein, 451 aa, Artificial Sequence
  heavy chain of 1564 IgG
EVQLLESGGGLVQPGGSLRLSCAASGFTFSSYDMSWVRQAPGKGLEWVSAISYDNGNTYYADSVKGRFTISRDNSKNTLYLQMNSLRAEDTAVYYCAKGVLTTLMNWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 451 aa, Artificial Sequence
  heavy chain of 1226 IgG
EVQLLESGGGLVQPGGSLRLSCAVSGFTFSNYDMSWVRQAPGKCLEWVSSISPDGGSKYYADSVKGRFTISRDNSKNTLYLQMNSLRAEDTAVYYCARDGGTHWLSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 457 aa, Artificial Sequence
  heavy chain of 996 IgG
EVQLLESGGGLVQTGGSLRLSCAASGFTFSSYDMSWVRQAPGKCLEWVSGIYHDGSSTYYADSVQGRFTISRDNSKNTLYLQMNSLRAEDTAVYYCARVSGTLSEPYAFFFNAMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - protein, 457 aa, Artificial Sequence
  heavy chain of 48G5 IgG
EVQLLESGGGLVQPGGSLRLSCAASGFTFSDYDMSWVRQAPGKCLEWVSSIYPNGSSKYYADSVKGRFTISRDNSKNTLYLQMNSLRAEDTAVYYCAKAGINCTTLRCSSYDAMDVWGQGTLATVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 457 aa, Artificial Sequence
  heavy chain of 54H4 IgG
EVQLLESGGGLVQPGGSLRLSCAASGFTFSDYDMSWVRQAPGKCLEWVSAISSDGSSAYYAASVKGRFTISRDNSKNTLYLQMNSLRAEDTAVYYCAKATIYTSDAPWSSYDAMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 418 - protein, 457 aa, Artificial Sequence
  heavy chain of 60H6 IgG
EVQLLESGGGLVQPGGSLRLSCAASGFTFSDYDMSWVRQAPGKCLEWVSMIYSGSSSKYYADSVKGRFTISRDNSKNTLYLQMNSLRAEDTAVYYCARASIACTLQACSYDNAMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 457 aa, Artificial Sequence
  heavy chain of B11 IgG
EVQLLESGGGLVQPGGSLRLSCAASGFTFSDYDMSWVRQAPGKGLEWVSAISYDNGNKYYADSVKGRFTISRDNSKNTLYLQMNSLRAEDTAVYYCAKAGVACTEHMCSSYDAMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 217 aa, Artificial Sequence
  light chain of 1564 IgG
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 421 - protein, 217 aa, Artificial Sequence
  light chain of 1226 IgG
QSVPTQPPSASGTPGQRVTISCTGSSSNIGNNTVSWYQQLPGTAPKLLIYYDNHRPSGVPDRFSGSKSGTSASLAISGLRSEDEADYYCGSWDASLNGYVFGCGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 422 - protein, 217 aa, Artificial Sequence
  light chain of 996 IgG
QSVLTQPPSASGTPGQRVTISCTGSSSNIGSNAVNWYQQLPGTAPKLLIYSNSHRPSGVPDRFSGSKSGTSASLAISGLRSEDEADYYCATWDYSLSGYVFGCGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 423 - protein, 217 aa, Artificial Sequence
  light chain of 48G5 IgG
QSVLTQPPSASGTPGQRVTISCSGSSSNIGNNDVSWYQQLPGTAPKLLIYDNNHRPSGVPDRFSGSKSGTSASLAISGLRSEDEADYYCAAWDDSLNAYVFGCGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 424 - protein, 217 aa, Artificial Sequence
  light chain of 54H4 IgG
QSVLTQPPSASGTPGQRVTISCSGSSSNIGSNTVTWYQQLPGTAPKLLIYADSKRPSGVPDRFSGSKSGTSASLAISGLRSEDEADYYCGTWDDSLNAYVFGCGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 425 - protein, 217 aa, Artificial Sequence
  light chain of 60H6 IgG
QSVLTQPPSASGTPGRRVTISCTGSSSNIGNNDVSWYQQLPGTAPKLLIYANSHRPSGVPDRFSGSKSGTSASLAISGLRSEDEADYYCGSWDDSLNGYVFGCGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 426 - protein, 217 aa, Artificial Sequence
  light chain of B11 IgG
QSVLTQPPSASGTPGQRVTISCSGSSSNIGNNDVSWYQQLPGTAPKLLIYDDNHRPSGVPDRFSGSKSGTSASLAISGLRSEDEADYYCGAWDYSLSGYVFGCGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 427 - protein, 251 aa, Artificial Sequence
  1564 scFv
QSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 428 - protein, 251 aa, Artificial Sequence
  1226 scFv
QSVPTQPPSASGTPGQRVTISCTGSSSNIGNNTVSWYQQLPGTAPKLLIYYDNHRPSGVPDRFSGSKSGTSASLAISGLRSEDEADYYCGSWDASLNGYVFGCGTKLTVLGGGGSGGGGSGGGGSGGGGSEVQLLESGGGLVQPGGSLRLSCAVSGFTFSNYDMSWVRQAPGKCLEWVSSISPDGGSKYYADSVKGRFTISRDNSKNTLYLQMNSLRAEDTAVYYCARDGGTHWLSLFDYWGQGTLVTVSS

SEQ ID NO: 429 - protein, 257 aa, Artificial Sequence
  996 scFv
QSVLTQPPSASGTPGQRVTISCTGSSSNIGSNAVNWYQQLPGTAPKLLIYSNSHRPSGVPDRFSGSKSGTSASLAISGLRSEDEADYYCATWDYSLSGYVFGCGTKLTVLGGGGSGGGGSGGGGSGGGGSEVQLLESGGGLVQTGGSLRLSCAASGFTFSSYDMSWVRQAPGKCLEWVSGIYHDGSSTYYADSVQGRFTISRDNSKNTLYLQMNSLRAEDTAVYYCARVSGTLSEPYAFFFNAMDVWGQGTLVTVSS

SEQ ID NO: 430 - protein, 257 aa, Artificial Sequence
  48G5 scFv
QSVLTQPPSASGTPGQRVTISCSGSSSNIGNNDVSWYQQLPGTAPKLLIYDNNHRPSGVPDRFSGSKSGTSASLAISGLRSEDEADYYCAAWDDSLNAYVFGCGTKLTVLGGGGSGGGGSGGGGSGGGGSEVQLLESGGGLVQPGGSLRLSCAASGFTFSDYDMSWVRQAPGKCLEWVSSIYPNGSSKYYADSVKGRFTISRDNSKNTLYLQMNSLRAEDTAVYYCAKAGINCTTLRCSSYDAMDVWGQGTLATVSS

SEQ ID NO: 431 - protein, 257 aa, Artificial Sequence
  54H4 scFv
QSVLTQPPSASGTPGQRVTISCSGSSSNIGSNTVTWYQQLPGTAPKLLIYADSKRPSGVPDRFSGSKSGTSASLAISGLRSEDEADYYCGTWDDSLNAYVFGCGTKLTVLGGGGSGGGGSGGGGSGGGGSEVQLLESGGGLVQPGGSLRLSCAASGFTFSDYDMSWVRQAPGKCLEWVSAISSDGSSAYYAASVKGRFTISRDNSKNTLYLQMNSLRAEDTAVYYCAKATIYTSDAPWSSYDAMDVWGQGTLVTVSS

SEQ ID NO: 432 - protein, 257 aa, Artificial Sequence
  60H6 scFv
QSVLTQPPSASGTPGRRVTISCTGSSSNIGNNDVSWYQQLPGTAPKLLIYANSHRPSGVPDRFSGSKSGTSASLAISGLRSEDEADYYCGSWDDSLNGYVFGCGTKLTVLGGGGSGGGGSGGGGSGGGGSEVQLLESGGGLVQPGGSLRLSCAASGFTFSDYDMSWVRQAPGKCLEWVSMIYSGSSSKYYADSVKGRFTISRDNSKNTLYLQMNSLRAEDTAVYYCARASIACTLQACSYDNAMDVWGQGTLVTVSS

SEQ ID NO: 433 - protein, 257 aa, Artificial Sequence
  B11 scFv
QSVLTQPPSASGTPGQRVTISCSGSSSNIGNNDVSWYQQLPGTAPKLLIYDDNHRPSGVPDRFSGSKSGTSASLAISGLRSEDEADYYCGAWDYSLSGYVFGCGTKLTVLGGGGSGGGGSGGGGSGGGGSEVQLLESGGGLVQPGGSLRLSCAASGFTFSDYDMSWVRQAPGKCLEWVSAISYDNGNKYYADSVKGRFTISRDNSKNTLYLQMNSLRAEDTAVYYCAKAGVACTEHMCSSYDAMDVWGQGTLVTVSS

SEQ ID NO: 434 - protein, 10 aa, Artificial Sequence
  VH CDR1 of anti-a-syn antibody
GFTFSDFYME

SEQ ID NO: 435 - protein, 19 aa, Artificial Sequence
  VH CDR2 of anti-a-syn antibody
ASRNKANDYTTEYSASVKG

SEQ ID NO: 436 - protein, 19 aa, Artificial Sequence
  VH CDR2 of anti-a-syn antibody
AIRNKANDYTTEYAASVKG

SEQ ID NO: 437 - protein, 19 aa, Artificial Sequence
  VH CDR2 of anti-a-syn antibody
ATRNKANDYTTEYSASVKG

SEQ ID NO: 438 - protein, 9 aa, Artificial Sequence
  VH CDR3 of anti-a-syn antibody
DAHGKPFAY

SEQ ID NO: 439 - protein, 10 aa, Artificial Sequence
  VH CDR1 of anti-a-syn antibody
GFTFSSYAMS

SEQ ID NO: 440 - protein, 17 aa, Artificial Sequence
  VH CDR2 of anti-a-syn antibody
TISNGGGYTYYPDSVKG

SEQ ID NO: 441 - protein, 17 aa, Artificial Sequence
  VH CDR2 of anti-a-syn antibody
TISNGGGYTYYADSVKG

SEQ ID NO: 442 - protein, 13 aa, Artificial Sequence
  VH CDR3 of anti-a-syn antibody
HITTVRPTKYFDY

SEQ ID NO: 443 - protein, 17 aa, Artificial Sequence
  VL CDR1 of anti-a-syn antibody
KSSQSLLYSSNQKNYLA

SEQ ID NO: 444 - protein, 7 aa, Artificial Sequence
  VL CDR2 of anti-a-syn antibody
WASTRES

SEQ ID NO: 445 - protein, 9 aa, Artificial Sequence
  VL CDR3 of anti-a-syn antibody
QQYYSYPWT

SEQ ID NO: 446 - protein, 11 aa, Artificial Sequence
  VL CDR1 of anti-a-syn antibody
KASQNVGTTVA

SEQ ID NO: 447 - protein, 7 aa, Artificial Sequence
  VL CDR2 of anti-a-syn antibody
SASNRYT

SEQ ID NO: 448 - protein, 9 aa, Artificial Sequence
  VL CDR3 of anti-a-syn antibody
QQYSNYPLT

SEQ ID NO: 449 - protein, 25 aa, Artificial Sequence
  H-FR1 of anti-a-syn antibody
EVQLQESGGGLVQPGGSLRLSCATS

SEQ ID NO: 450 - protein, 25 aa, Artificial Sequence
  H-FR1 of anti-a-syn antibody
EVQLVESGGGLVQPGGSLRLSCATS

SEQ ID NO: 451 - protein, 14 aa, Artificial Sequence
  H-FR2 of anti-a-syn antibody
WVRQPPGKRLEWIA

SEQ ID NO: 452 - protein, 14 aa, Artificial Sequence
  H-FR2 of anti-a-syn antibody
WVRQAPGKGLEWIA

SEQ ID NO: 453 - protein, 32 aa, Artificial Sequence
  H-FR3 of anti-a-syn antibody
RFIVSRDTSQSILYLQMNALRAEDTAIYYCAR

SEQ ID NO: 454 - protein, 32 aa, Artificial Sequence
  H-FR3 of anti-a-syn antibody
RFTVSRDTSKNSLYLQMNSLKTEDTAVYYCAR

SEQ ID NO: 455 - protein, 32 aa, Artificial Sequence
  H-FR3 of anti-a-syn antibody
RFTISRDTSKNSLYLQMNSLKTEDTAVYYCAR

SEQ ID NO: 456 - protein, 32 aa, Artificial Sequence
  H-FR3 of anti-a-syn antibody
RFTVSRDTSQNTLYLQMNSLRAEDTAVYYCAR

SEQ ID NO: 457 - protein, 32 aa, Artificial Sequence
  H-FR3 of anti-a-syn antibody
RFTISADTSKNTAYLQMNSLRAEDTAVYYCSR

SEQ ID NO: 458 - protein, 32 aa, Artificial Sequence
  H-FR3 of anti-a-syn antibody
RFTISRDDSKSSLYLQMNSLRAEDTAIYYCAR

SEQ ID NO: 459 - protein, 32 aa, Artificial Sequence
  H-FR3 of anti-a-syn antibody
RFTISRDTSQSSLYLQMNSLKTEDTAVYYCAR

SEQ ID NO: 460 - protein, 32 aa, Artificial Sequence
  H-FR3 of anti-a-syn antibody
RFTISRDTSQSSLYLQMNSLRAEDTAIYYCAR

SEQ ID NO: 461 - protein, 32 aa, Artificial Sequence; identical to SEQ ID NO: 458
  H-FR3 of anti-a-syn antibody

SEQ ID NO: 462 - protein, 32 aa, Artificial Sequence
  H-FR3 of anti-a-syn antibody
RFTVSRDDSKSSLYLQMNSLRAEDTAIYYCAR

SEQ ID NO: 463 - protein, 32 aa, Artificial Sequence
  H-FR3 of anti-a-syn antibody
RFTISRDTSKSSLYLQMNSLRAEDTAIYYCAR

SEQ ID NO: 464 - protein, 32 aa, Artificial Sequence
  H-FR3 of anti-a-syn antibody
RFTVSRDTSKSSLYLQMNSLRAEDTAIYYCAR

SEQ ID NO: 465 - protein, 11 aa, Artificial Sequence
  H-FR4 of anti-a-syn antibody
WGQGTLVTVSA

SEQ ID NO: 466 - protein, 11 aa, Artificial Sequence
  H-FR4 of anti-a-syn antibody
WGQGTLVTVSS

SEQ ID NO: 467 - protein, 11 aa, Artificial Sequence
  H-FR4 of anti-a-syn antibody
WGQGTTVTVSS

SEQ ID NO: 468 - protein, 25 aa, Artificial Sequence
  H-FR1 of anti-a-syn antibody
EVQLQESGGGLVKPGGSLKLSCAAS

SEQ ID NO: 469 - protein, 25 aa, Artificial Sequence
  H-FR1 of anti-a-syn antibody
QVQLLESGGGLVQPGGSLRLSCAAS

SEQ ID NO: 470 - protein, 25 aa, Artificial Sequence
  H-FR1 of anti-a-syn antibody
EVQLVQSGGGLVQPGGSLRLSCAAS

SEQ ID NO: 471 - protein, 25 aa, Artificial Sequence [sequence omitted]

SEQ ID NO: 472 - protein, 25 aa, Artificial Sequence
  H-FR1 of anti-a-syn antibody
EVQLLESGGGLVQPGGSLRLSCAAS

SEQ ID NO: 473 - protein, 25 aa, Artificial Sequence
  H-FR1 of anti-a-syn antibody
EVQLLESGGGLVQPGGSLKLSCAAS

SEQ ID NO: 474 - protein, 14 aa, Artificial Sequence
  H-FR2 of anti-a-syn antibody
WVRQTPEKRLEWVA

SEQ ID NO: 475 - protein, 14 aa, Artificial Sequence
  H-FR2 of anti-a-syn antibody
WVRQAPGKGLEWVA

SEQ ID NO: 476 - protein, 14 aa, Artificial Sequence
  H-FR2 of anti-a-syn antibody
WVRQAPDKGLEWVA

SEQ ID NO: 477 - protein, 14 aa, Artificial Sequence
  H-FR2 of anti-a-syn antibody
WVRQTPEKGLEWVA

SEQ ID NO: 478 - protein, 32 aa, Artificial Sequence
  H-FR3 of anti-a-syn antibody
RFTISRDNAKNTLYLQMSSLRSEDTAMYYCAR

SEQ ID NO: 479 - protein, 32 aa, Artificial Sequence
  H-FR3 of anti-a-syn antibody
RFTISRDNAKNTLYLQMNSLRSEDSAMYYCAR

SEQ ID NO: 480 - protein, 32 aa, Artificial Sequence
  H-FR3 of anti-a-syn antibody
RFTISRDNAKNTLYLQMSSLKAEDSAVYYCAR

SEQ ID NO: 481 - protein, 32 aa, Artificial Sequence; identical to SEQ ID NO: 89
  H-FR3 of anti-a-syn antibody

SEQ ID NO: 482 - protein, 32 aa, Artificial Sequence
  H-FR3 of anti-a-syn antibody
RFTISADTSKNTAYLQMNSLRAEDTAVYYCAR

SEQ ID NO: 483 - protein, 32 aa, Artificial Sequence
  H-FR3 of anti-a-syn antibody
RFTISRDNSKNTLYLQMSSLRAEDTAMYYCAR

SEQ ID NO: 484 - protein, 11 aa, Artificial Sequence
  H-FR4 of anti-a-syn antibody
WGQGTTLTVSS

SEQ ID NO: 485 - protein, 11 aa, Artificial Sequence
  H-FR4 of anti-a-syn antibody
WGQGTLVTVSS

SEQ ID NO: 486 - protein, 23 aa, Artificial Sequence
  L-FR1 of anti-a-syn antibody
DIVMTQSPSSLAVSVGEKVTMSC

SEQ ID NO: 487 - protein, 23 aa, Artificial Sequence
  L-FR1 of anti-a-syn antibody
DIVMTQSPDSLAVSLGERATINC

SEQ ID NO: 488 - protein, 23 aa, Artificial Sequence
  L-FR1 of anti-a-syn antibody
DIVMTQSPSSLAVSLGERVTITC

SEQ ID NO: 489 - protein, 23 aa, Artificial Sequence
  L-FR1 of anti-a-syn antibody
DIVMTQSPSSLAVSLGERATINC

SEQ ID NO: 490 - protein, 23 aa, Artificial Sequence
  L-FR1 of anti-a-syn antibody
DIQMTQSPSSLSASVGDRVTITC

SEQ ID NO: 491 - protein, 23 aa, Artificial Sequence
  L-FR1 of anti-a-syn antibody
DIVMTQSPSSLAVSLGERVTMSC

SEQ ID NO: 492 - protein, 15 aa, Artificial Sequence
  L-FR2 of anti-a-syn antibody
WYQQKPGQSPKLLIY

SEQ ID NO: 493 - protein, 15 aa, Artificial Sequence
  L-FR2 of anti-a-syn antibody
WYQQKPGQPPKLLIY

SEQ ID NO: 494 - protein, 15 aa, Artificial Sequence
  L-FR2 of anti-a-syn antibody
WYQQKPGKAPKLLIY

SEQ ID NO: 495 - protein, 32 aa, Artificial Sequence
  L-FR3 of anti-a-syn antibody
GVPDRFTGSGSGTDFTLTISSVKAEDLAVYYC

SEQ ID NO: 496 - protein, 32 aa, Artificial Sequence
  L-FR3 of anti-a-syn antibody
GVPDRFSGSGSGTDFTLTISSLQAEDVAVYYC

SEQ ID NO: 497 - protein, 32 aa, Artificial Sequence
  L-FR3 of anti-a-syn antibody
GVPDRFSGSGSGTDFTLTISSVQAEDVAVYYC

SEQ ID NO: 498 - protein, 32 aa, Artificial Sequence
  L-FR3 of anti-a-syn antibody
GVPSRFSGSGSGTDFTLTISSLQPEDFATYYC

SEQ ID NO: 499 - protein, 32 aa, Artificial Sequence
  L-FR3 of anti-a-syn antibody
GVPDRFSGSGSGTDFTLTISSVQAEDLAVYYC

SEQ ID NO: 500 - protein, 32 aa, Artificial Sequence
  L-FR3 of anti-a-syn antibody
GVPDRFTGSGSGTDFTLTISSVKAEDVAVYYC

SEQ ID NO: 501 - protein, 10 aa, Artificial Sequence
  L-FR4 of anti-a-syn antibody
FGGGTKLEIK

SEQ ID NO: 502 - protein, 10 aa, Artificial Sequence
  L-FR4 of anti-a-syn antibody
FGGGTKVEIK

SEQ ID NO: 503 - protein, 10 aa, Artificial Sequence
  L-FR4 of anti-a-syn antibody
FGQGTKVEIK

SEQ ID NO: 504 - protein, 23 aa, Artificial Sequence
  L-FR1 of anti-a-syn antibody
DIVMTQSPKFMSTSVGDRVSITC

SEQ ID NO: 505 - protein, 23 aa, Artificial Sequence
  L-FR1 of anti-a-syn antibody
DIQMTQSPSSLSASVGDRVTITC

SEQ ID NO: 506 - protein, 23 aa, Artificial Sequence
  L-FR1 of anti-a-syn antibody
DIVMTQSPSTLSASVGDRVTITC

SEQ ID NO: 507 - protein, 23 aa, Artificial Sequence
  L-FR1 of anti-a-syn antibody
DIVMTQSPATLSVSLGERATLSC

SEQ ID NO: 508 - protein, 23 aa, Artificial Sequence
  L-FR1 of anti-a-syn antibody
DIQMTQSPSSLSASVGDRVTITC

SEQ ID NO: 509 - protein, 23 aa, Artificial Sequence
  L-FR1 of anti-a-syn antibody
DIQMTQSPSSLSASVGDRVTITC

SEQ ID NO: 510 - protein, 23 aa, Artificial Sequence
  L-FR1 of anti-a-syn antibody
DIVMTQSPSSMSTSVGDRVTITC

SEQ ID NO: 511 - protein, 15 aa, Artificial Sequence
  L-FR2 of anti-a-syn antibody
WYQQKPGQSPKLLIY

SEQ ID NO: 512 - protein, 15 aa, Artificial Sequence
  L-FR2 of anti-a-syn antibody
WYQQKPGKAPKLLIY

SEQ ID NO: 513 - protein, 16 aa, Artificial Sequence
  L-FR2 of anti-a-syn antibody
AWYQQKPGKAPKLLIY

SEQ ID NO: 514 - protein, 15 aa, Artificial Sequence
  L-FR2 of anti-a-syn antibody
WYQQKPGQAPRLLIY

SEQ ID NO: 515 - protein, 32 aa, Artificial Sequence
  L-FR3 of anti-a-syn antibody
GVPDRFTGSGSGTDFTLTISNMQSEDLADYFC

SEQ ID NO: 516 - protein, 32 aa, Artificial Sequence
  L-FR3 of anti-a-syn antibody
GVPDRFSGSGSGTDFTLTISSLQPEDFATYYC

SEQ ID NO: 517 - protein, 32 aa, Artificial Sequence
  L-FR3 of anti-a-syn antibody
GVPSRFSGSGSGTEFTLTISSLQPDDFASYYC

SEQ ID NO: 518 - protein, 32 aa, Artificial Sequence
  L-FR3 of anti-a-syn antibody
GIPARFSGSGSGTEFTLTISSLQSEDFAVYYC

SEQ ID NO: 519 - protein, 32 aa, Artificial Sequence; identical to SEQ ID NO: 498
  L-FR3 of anti-a-syn antibody

SEQ ID NO: 520 - protein, 32 aa, Artificial Sequence
  L-FR3 of anti-a-syn antibody
GVPDRFSGSGSGTDFTFTISSMQSEDIATYFC

SEQ ID NO: 521 - protein, 32 aa, Artificial Sequence
  L-FR3 of anti-a-syn antibody
GVPDRFSGSGSGTDFTLTISSMQSEDLADYYC

SEQ ID NO: 522 - protein, 10 aa, Artificial Sequence
  L-FR4 of anti-a-syn antibody
FGAGTKLELR

SEQ ID NO: 523 - protein, 120 aa, Artificial Sequence
  heavy chain variable region of anti-a-syn antibody
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSA

SEQ ID NO: 524 - protein, 120 aa, Artificial Sequence
  heavy chain variable region of anti-a-syn antibody
EVQLVESGGGLVQPGGSLRLSCAASGFTFSDFYMEWVRQAPGKGLEWIAAIRNKANDYTTEYAASVKGRFTVSRDTSKNSLYLQMNSLKTEDTAVYYCARDAHGKPFAYWGQGTLVTVSS

SEQ ID NO: 525 - protein, 120 aa, Artificial Sequence
  heavy chain variable region of anti-a-syn antibody
EVQLVESGGGLVQPGGSLRLSCAASGFTFSDFYMEWVRQAPGKGLEWIAAIRNKANDYTTEYAASVKGRFTISRDTSKNSLYLQMNSLKTEDTAVYYCARDAHGKPFAYWGQGTLVTVSS

SEQ ID NO: 526 - protein, 120 aa, Artificial Sequence
  heavy chain variable region of anti-a-syn antibody
EVQLVESGGGLVQPGGSLRLSCAASGFTFSDFYMEWVRQAPGKGLEWIAAIRNKANDYTTEYADSVKGRFTVSRDTSQNTLYLQMNSLRAEDTAVYYCARDAHGKPFAYWGQGTLVTVSS

SEQ ID NO: 527 - protein, 120 aa, Artificial Sequence
  heavy chain variable region of anti-a-syn antibody
EVQLVESGGGLVQPGGSLRLSCAASGFTFSDFYMEWVRQAPGKGLEWVAAIRNKANDYTTEYADSVKGRFTISADTSKNTAYLQMNSLRAEDTAVYYCSRDAHGKPFAYWGQGTLVTVSS

SEQ ID NO: 528 - protein, 120 aa, Artificial Sequence
  heavy chain variable region of anti-a-syn antibody
EVQLVESGGGLVQPGGSLRLSCATSGFTFSDFYMEWVRQPPGKRLEWIAATRNKANDYTTEYSASVKGRFTISRDDSKSSLYLQMNSLRAEDTAIYYCARDAHGKPFAYWGQGTTVTVSS

SEQ ID NO: 529 - protein, 120 aa, Artificial Sequence
  heavy chain variable region of anti-a-syn antibody
EVQLVESGGGLVQPGGSLRLSCATSGFTFSDFYMEWVRQPPGKRLEWIAATRNKANDYTTEYSASVKGRFTISRDTSQSSLYLQMNSLKTEDTAVYYCARDAHGKPFAYWGQGTTVTVSS

SEQ ID NO: 530 - protein, 120 aa, Artificial Sequence
  heavy chain variable region of anti-a-syn antibody
EVQLVESGGGLVQPGGSLRLSCATSGFTFSDFYMEWVRQPPGKRLEWIAATRNKANDYTTEYSASVKGRFTISRDTSQSSLYLQMNSLRAEDTAIYYCARDAHGKPFAYWGQGTTVTVSS

SEQ ID NO: 531 - protein, 120 aa, Artificial Sequence
  heavy chain variable region of anti-a-syn antibody
EVQLVESGGGLVQPGGSLRLSCATSGFTFSDFYMEWVRQPPGKRLEWIAASRNKANDYTTEYSASVKGRFTISRDDSKSSLYLQMNSLRAEDTAIYYCARDAHGKPFAYWGQGTTVTVSS

SEQ ID NO: 532 - protein, 120 aa, Artificial Sequence
  heavy chain variable region of anti-a-syn antibody
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSS

SEQ ID NO: 533 - protein, 120 aa, Artificial Sequence
  heavy chain variable region of anti-a-syn antibody
EVQLVESGGGLVQPGGSLRLSCATSGFTFSDFYMEWVRQPPGKRLEWIAASRNKANDYTTEYSASVKGRFTISRDTSKSSLYLQMNSLRAEDTAIYYCARDAHGKPFAYWGQGTTVTVSS

SEQ ID NO: 534 - protein, 120 aa, Artificial Sequence
  heavy chain variable region of anti-a-syn antibody
EVQLVESGGGLVQPGGSLRLSCATSGFTFSDFYMEWVRQPPGKRLEWIAASRNKANDYTTEYSASVKGRFTVSRDTSKSSLYLQMNSLRAEDTAIYYCARDAHGKPFAYWGQGTTVTVSS

SEQ ID NO: 535 - protein, 122 aa, Artificial Sequence
  heavy chain variable region of anti-a-syn antibody
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSS

SEQ ID NO: 536 - protein, 122 aa, Artificial Sequence
  heavy chain variable region of anti-a-syn antibody
QVQLLESGGGLVQPGGSLRLSCAASGFTFSSYAMSWVRQAPGKGLEWVATISNGGGYTYYPDSVKGRFTISRDNAKNTLYLQMNSLRSEDSAMYYCARHITTVRPTKYFDYWGQGTLVTVSS

SEQ ID NO: 537 - protein, 122 aa, Artificial Sequence
  heavy chain variable region of anti-a-syn antibody
EVQLVQSGGGLVQPGGSLRLSCAASGFTFSSYAMSWVRQAPDKGLEWVATISNGGGYTYYADSVKGRFTISRDNAKNTLYLQMSSLKAEDSAVYYCARHITTVRPTKYFDYWGQGTLVTVSS

SEQ ID NO: 538 - protein, 122 aa, Artificial Sequence
  heavy chain variable region of anti-a-syn antibody
EVQLVESGGGLVQPGGSLRLSCAASGFTFSSYAMSWVRQAPGKGLEWVATISNGGGYTYYPDSVKGRFTISRDNSKNTLYLQMNSLRAEDTAVYYCARHITTVRPTKYFDYWGQGTLVTVSS

SEQ ID NO: 539 - protein, 122 aa, Artificial Sequence
  heavy chain variable region of anti-a-syn antibody
EVQLVESGGGLVQPGGSLRLSCAASGFTFSSYAMSWVRQAPGKGLEWVATISNGGGYTYYADSVKGRFTISADTSKNTAYLQMNSLRAEDTAVYYCARHITTVRPTKYFDYWGQGTLVTVSS

SEQ ID NO: 540 - protein, 122 aa, Artificial Sequence
  heavy chain variable region of anti-a-syn antibody
EVQLLESGGGLVQPGGSLRLSCAASGFTFSSYAMSWVRQTPEKGLEWVATISNGGGYTYYPDSVKGRFTISRDNSKNTLYLQMSSLRAEDTAMYYCARHITTVRPTKYFDYWGQGTTLTVSS

SEQ ID NO: 541 - protein, 122 aa, Artificial Sequence
  heavy chain variable region of anti-a-syn antibody
EVQLLESGGGLVQPGGSLKLSCAASGFTFSSYAMSWVRQTPEKGLEWVATISNGGGYTYYPDSVKGRFTISRDNSKNTLYLQMSSLRAEDTAMYYCARHITTVRPTKYFDYWGQGTTLTVSS

SEQ ID NO: 542 - protein, 113 aa, Artificial Sequence
  light chain variable region of anti-a-syn antibody
DIVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPWTFGGGTKLEIK

SEQ ID NO: 543 - protein, 113 aa, Artificial Sequence
  light chain variable region of anti-a-syn antibody
DIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPWTFGGGTKVEIK

SEQ ID NO: 544 - protein, 113 aa, Artificial Sequence
  light chain variable region of anti-a-syn antibody
DIVMTQSPSSLAVSLGERVTITCKSSQSLLYSSNQKNYLAWYQQKPGQPPKLLIYWASTRESGVPDRFSGSGSGTDFTLTISSVQAEDVAVYYCQQYYSYPWTFGGGTKLEIK

SEQ ID NO: 545 - protein, 113 aa, Artificial Sequence
  light chain variable region of anti-a-syn antibody
DIVMTQSPSSLAVSLGERATINCKSSQSLLYSSNQKNYLAWYQQKPGQPPKLLIYWASTRESGVPDRFSGSGSGTDFTLTISSLQAEDVAVYYCQQYYSYPWTFGGGTKLEIK

SEQ ID NO: 546 - protein, 113 aa, Artificial Sequence
  light chain variable region of anti-a-syn antibody
DIQMTQSPSSLSASVGDRVTITCKSSQSLLYSSNQKNYLAWYQQKPGKAPKLLIYWASTRESGVPSRFSGSGSGTDFTLTISSLQPEDFATYYCQQYYSYPWTFGQGTKVEIK

SEQ ID NO: 547 - protein, 113 aa, Artificial Sequence
  light chain variable region of anti-a-syn antibody
DIVMTQSPSSLAVSVGEKVTMSCKSSQSLLYSSNQKNYLAWYQQKPGQPPKLLIYWASTRESGVPDRFSGSGSGTDFTLTISSVQAEDLAVYYCQQYYSYPWTFGGGTKLEIK

SEQ ID NO: 548 - protein, 113 aa, Artificial Sequence
  light chain variable region of anti-a-syn antibody
DIVMTQSPSSLAVSLGERVTMSCKSSQSLLYSSNQKNYLAWYQQKPGQSPKLLIYWASTRESGVPDRFTGSGSGTDFTLTISSVKAEDVAVYYCQQYYSYPWTFGGGTKLEIK

SEQ ID NO: 549 - protein, 107 aa, Artificial Sequence
  light chain variable region of anti-a-syn antibody
DIVMTQSPKFMSTSVGDRVSITCKASQNVGTTVAWYQQKPGQSPKLLIYSASNRYTGVPDRFTGSGSGTDFTLTISNMQSEDLADYFCQQYSNYPLTFGAGTKLELR

SEQ ID NO: 550 - protein, 107 aa, Artificial Sequence
  light chain variable region of anti-a-syn antibody
DIQMTQSPSSLSASVGDRVTITCKASQNVGTTVAWYQQKPGKAPKLLIYSASNRYTGVPDRFSGSGSGTDFTLTISSLQPEDFATYYCQQYSNYPLTFGGGTKLEIK

SEQ ID NO: 551 - protein, 107 aa, Artificial Sequence
  light chain variable region of anti-a-syn antibody
DIVMTQSPSTLSASVGDRVTITCKASQNVGTTVAWYQQKPGKAPKLLIYSASNRYTGVPSRFSGSGSGTEFTLTISSLQPDDFASYYCQQYSNYPLTFGQGTKVEIK

SEQ ID NO: 552 - protein, 107 aa, Artificial Sequence
  light chain variable region of anti-a-syn antibody
DIVMTQSPATLSVSLGERATLSCKASQNVGTTVAWYQQKPGQAPRLLIYSASNRYTGIPARFSGSGSGTEFTLTISSLQSEDFAVYYCQQYSNYPLTFGGGTKVEIK

SEQ ID NO: 553 - protein, 107 aa, Artificial Sequence
  light chain variable region of anti-a-syn antibody
DIQMTQSPSSLSASVGDRVTITCKASQNVGTTVAWYQQKPGKAPKLLIYSASNRYTGVPSRFSGSGSGTDFTLTISSLQPEDFATYYCQQYSNYPLTFGQGTKVEIK

SEQ ID NO: 554 - protein, 107 aa, Artificial Sequence
  light chain variable region of anti-a-syn antibody
DIQMTQSPSSLSASVGDRVTITCKASQNVGTTVAWYQQKPGQSPKLLIYSASNRYTGVPDRFSGSGSGTDFTFTISSMQSEDIATYFCQQYSNYPLTFGQGTKLEIK

SEQ ID NO: 555 - protein, 107 aa, Artificial Sequence
  light chain variable region of anti-a-syn antibody
DIVMTQSPSSMSTSVGDRVTITCKASQNVGTTVAWYQQKPGQSPKLLIYSASNRYTGVPDRFSGSGSGTDFTLTISSMQSEDIADYYCQQYSNYPLTFGQGTKLEIK

SEQ ID NO: 556 - protein, 107 aa, Artificial Sequence
  light chain variable region of anti-a-syn antibody
DIVMTQSPSSMSTSVGDRVTITCKASQNVGTTVAWYQQKPGQSPKLLIYSASNRYTGVPDRFSGSGSGTDFTLTISSMQSEDLADYYCQQYSNYPLTFGQGTKLEIK

SEQ ID NO: 557 - protein, 116 aa, Artificial Sequence
  light chain variable region of anti-a-syn antibody
EVQLQESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQDFDYWGQGTTLTVSS

SEQ ID NO: 558 - protein, 112 aa, Artificial Sequence
  light chain variable region of anti-a-syn antibody
DIVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLEQK

SEQ ID NO: 559 - protein, 140 aa, Artificial Sequence
  human alpha-synuclein protein
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 560 - protein, 450 aa, Artificial Sequence
  Hu11F11-VH-v1
EVQLVESGGGLVQPGGSLRLSCATSGFTFSDFYMEWVRQPPGKRLEWIAASRNKANDYTTEYSASVKGRFTISRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 561 - protein, 450 aa, Artificial Sequence
  Hu11F11-VH-v2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 450 aa, Artificial Sequence
  Hu11F11-VH-v3
EVQLVESGGGLVQPGGSLRLSCATSGFTFSDFYMEWVRQPPGKRLEWIAASRNKANDYTTEYSASVKGRFTISRDTSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - protein, 450 aa, Artificial Sequence
  Hu11F11-VH-v4
EVQLVESGGGLVQPGGSLRLSCATSGFTFSDFYMEWVRQPPGKRLEWIAASRNKANDYTTEYSASVKGRFTVSRDTSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 450 aa, Artificial Sequence
  Hu11F11-VH2
EVQLVESGGGLVQPGGSLRLSCAASGFTFSDFYMEWVRQAPGKGLEWIAAIRNKANDYTTEYAASVKGRFTISRDTSKNSLYLQMNSLKTEDTAVYYCARDAHGKPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 452 aa, Artificial Sequence
  hu3A9-VH5
EVQLQESGGGLVKPGGSLKLSCAASGFTFSSYAMSWVRQTPEKGLEWVATISNGGGYTYYPDSVKGRFTISRDNAKNTLYLQMNSLRSEDTAVYYCARHITTVRPTKYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 566 - protein, 220 aa, Artificial Sequence
  Hu11F11-VLv3 4c
DIVMTQSPSSLAVSLGERVTMSCKSSQSLLYSSNQKNYLAWYQQKPGQSPKLLIYWASTRESGVPDRFTGSGSGTDFTLTISSVKAEDVAVYYCQQYYSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 567 - protein, 220 aa, Artificial Sequence
  Hu11F11-VL4
DIQMTQSPSSLSASVGDRVTITCKSSQSLLYSSNQKNYLAWYQQKPGKAPKLLIYWASTRESGVPSRFSGSGSGTDFTLTISSLQPEDFATYYCQQYYSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 568 - protein, 214 aa, Artificial Sequence
  Hu3A9-VL3
DIVMTQSPATLSVSLGERATLSCKASQNVGTTVAWYQQKPGQAPRLLIYSASNRYTGIPARFSGSGSGTEFTLTISSLQSEDFAVYYCQQYSNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 569 - protein, 716 aa, Artificial Sequence
  ch11F11-1564-3 bivalent (HC)
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 570 - protein, 716 aa, Artificial Sequence
  ch11F11-1564-2 bivalent (HC)
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 571 - protein, 716 aa, Artificial Sequence
  ch11F11-1564-3 monovalent (HC 1, -hole) (1564-3 scFv)
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 572 - protein, 716 aa, Artificial Sequence
  ch11F11-1564-2 monovalent (HC 1, -hole) (1564-2 scFv)
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 573 - protein, 450 aa, Artificial Sequence
  CH11F11 (IGG) WITH KNOB MUTATION
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 574 - protein, 718 aa, Artificial Sequence
  ch3A9-1564-3 bivalent (HC)
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 575 - protein, 718 aa, Artificial Sequence
  ch3A9-1564-2 bivalent (HC)
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 576 - protein, 718 aa, Artificial Sequence
  ch3A9-1564-3 monovalent (HC 1, -hole)
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 577 - protein, 718 aa, Artificial Sequence
  ch3A9-1564-2 monovalent (HC 1, -hole)
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 578 - protein, 452 aa, Artificial Sequence
  CH3A9 (IGG) WITH KNOB MUTATION
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 716 aa, Artificial Sequence
  hu11F11(ver.2)-1564-3 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 580 - protein, 716 aa, Artificial Sequence
  hu11F11(ver.2)-1564-2 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 581 - protein, 716 aa, Artificial Sequence
  hu11F11(ver.2)-1564-3 monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 582 - protein, 716 aa, Artificial Sequence
  hu11F11(ver.2)-1564-2 monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 583 - protein, 450 aa, Artificial Sequence
  hu11F11(ver.2 (IGG) WITH KNOB MUTATION
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 330 aa, Artificial Sequence
  human IgG1 M428L mutated (CH1, CH2, CH3)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 585 - protein, 716 aa, Artificial Sequence
  hu11F11(ver.2)(M428L)-1564-DMP bivalent(HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 586 - protein, 716 aa, Artificial Sequence
  hu11F11(ver.2)(M428L)-1564-DM bivalen t(HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 587 - protein, 716 aa, Artificial Sequence
  hu11F11(ver.2)(M428L)-1564-DMP monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 588 - protein, 716 aa, Artificial Sequence
  hu11F11(ver.2)(M428L)-1564-DMP monovalent, (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 589 - protein, 450 aa, Artificial Sequence
  hu11F11(ver.2 (IGG), M428L, KNOB MUTATION
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHNHYTQKSLSLSPGK

SEQ ID NO: 590 - protein, 716 aa, Artificial Sequence
  hu11F11(ver.2)-C04-3 monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWEQWLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 591 - protein, 716 aa, Artificial Sequence
  hu11F11(ver.2)-C04-2 monovalent (HC 2, -knob)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWEQWLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 592 - protein, 716 aa, Artificial Sequence
  hu11F11(ver.2)-F06-3 monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGTWAGSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 593 - protein, 716 aa, Artificial Sequence
  hu11F11(ver.2)-F06-02 monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGTWAGSLNGYVFGCGTKLTVLGGGGSGGGGSGGGGSGGGGSEVQLLESGGGLVQPGGSLRLSCAASGFTFSSYDMSWVRQAPGKCLEWVSAISYDNGNTYYADSVKGRFTISRDNSKNTLYLQMNSLRAEDTAVYYCAKGVLTTLMNWFDYWGQGTLVTVSS

SEQ ID NO: 594 - protein, 716 aa, Artificial Sequence
  hu11F11(ver.2)-VH2-3 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISGSNGNTYYADSVKGRFTISRDNSKNTLYLQMNSLRAEDTAVYYCAKGVLTTLANWFDYWGQGTLVTVSS

SEQ ID NO: 595 - protein, 716 aa, Artificial Sequence
  hu11F11(ver.2)-VH2-2 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISGSNGNTYYADSVKGRFTISRDNSKNTLYLQMNSLRAEDTAVYYCAKGVLTTLANWFDYWGQGTLVTVSS

SEQ ID NO: 596 - protein, 716 aa, Artificial Sequence
  hu11F11(ver.2)-VH5-3 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISGDNGSTYYADSVKGRFTISRDNSKNTLYLQMNSLRAEDTAVYYCAKGVLTTLMNWFDSWGQGTLVTVSS

SEQ ID NO: 597 - protein, 716 aa, Artificial Sequence
  hu11F11(ver.2)-VH5-2 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISGDNGSTYYADSVKGRFTISRDNSKNTLYLQMNSLRAEDTAVYYCAKGVLTTLMNWFDSWGQGTLVTVSS

SEQ ID NO: 598 - protein, 716 aa, Artificial Sequence
  hu11F11(ver.2)-VH6-3 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYSNGNTYYADSVKGRFTISRDNSKNTLYLQMNSLRAEDTAVYYCAKGVLTTLANWFDYWGQGTLVTVSS

SEQ ID NO: 599 - protein, 716 aa, Artificial Sequence
  hu11F11(ver.2)-VH6-2 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYSNGNTYYADSVKGRFTISRDNSKNTLYLQMNSLRAEDTAVYYCAKGVLTTLANWFDYWGQGTLVTVSS

SEQ ID NO: 600 - protein, 716 aa, Artificial Sequence
  hu11F11(ver.2)-VH7-3 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISYDNGSTYYADSVKGRFTISRDNSKNTLYLQMNSLRAEDTAVYYCAKGVLTTLMNWFDYWGQGTLVTVSS

SEQ ID NO: 601 - protein, 716 aa, Artificial Sequence
  hu11F11(ver.2)-VH7-2 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISYDNGSTYYADSVKGRFTISRDNSKNTLYLQMNSLRAEDTAVYYCAKGVLTTLMNWFDYWGQGTLVTVSS

SEQ ID NO: 602 - protein, 716 aa, Artificial Sequence
  hu11F11(ver.2)-VH9 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISGDNGNTYYADSVKGRFTISRDNSKNTLYLQMNSLRAEDTAVYYCAKGVLTTLMNWFDYWGQGTLVTVSS

SEQ ID NO: 603 - protein, 716 aa, Artificial Sequence
  hu11F11(ver.2)-VH9 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISGDNGNTYYADSVKGRFTISRDNSKNTLYLQMNSLRAEDTAVYYCAKGVLTTLMNWFDYWGQGTLVTVSS

SEQ ID NO: 604 - protein, 716 aa, Artificial Sequence
  hu11F11(ver.2)-VH16 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISGSNGNTYYADSVKGRFTISRDNSKNTLYLQMNSLRAEDTAVYYCAKGVLTTLMNWFDYWGQGTLVTVSS

SEQ ID NO: 605 - protein, 716 aa, Artificial Sequence
  hu11F11(ver.2)-VH16 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISGSNGNTYYADSVKGRFTISRDNSKNTLYLQMNSLRAEDTAVYYCAKGVLTTLMNWFDYWGQGTLVTVSS

SEQ ID NO: 606 - protein, 716 aa, Artificial Sequence
  hu11F11(ver.2)-VH27 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISYDNGSTYYADSVKGRFTISRDNSKNTLYLQMNSLRAEDTAVYYCAKGVLTTLMNWFDSWGQGTLVTVSS

SEQ ID NO: 607 - protein, 716 aa, Artificial Sequence
  hu11F11(ver.2)-VH27 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISYDNGSTYYADSVKGRFTISRDNSKNTLYLQMNSLRAEDTAVYYCAKGVLTTLMNWFDSWGQGTLVTVSS

SEQ ID NO: 608 - protein, 716 aa, Artificial Sequence
  hu11F11(ver.2)-VH32 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISYDNGNTYYADSVKGRFTISRDNSKNTLYLQMNSLRAEDTAVYYCAKGVLTTLANWFDYWGQGTLVTVSS

SEQ ID NO: 609 - protein, 716 aa, Artificial Sequence
  hu11F11(ver.2)-VH32 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYAMSWVRQAPGKCLEWVSAISYDNGNTYYADSVKGRFTISRDNSKNTLYLQMNSLRAEDTAVYYCAKGVLTTLANWFDYWGQGTLVTVSS

SEQ ID NO: 610 - protein, 716 aa, Artificial Sequence
  hu11F11(ver.2)-VH35 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVPDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGSTYYADSVKGRFTISRDNSKNTLYLQMNSLRAEDTAVYYCAKGVLTTLMNWFDSWGQGTLVTVSS

SEQ ID NO: 611 - protein, 716 aa, Artificial Sequence
  hu11F11(ver.2)-VH35 bivalent (HC)_2
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQSVLTQPPSASGTPGQRVTISCTGSSSNIGSNDVSWYQQLPGTAPKLLIYANSNRPSGVSDRFSGSKSGTSASLAISGLRSEDEADYYCGAWDDSLNGYVFGCGTKLTVLGGGGSGGGGSGGGGSGGGGSEVQLLESGGGLVQPGGSLRLSCAASGFTFSSYDMSWVRQAPGKCLEWVSAISYDNGSTYYADSVKGRFTISRDNSKNTLYLQMNSLRAEDTAVYYCAKGVLTTLMNWFDSWGQGTLVTVSS

SEQ ID NO: 612 - protein, 716 aa, Artificial Sequence
  hu11F11(ver.2)(M428L)-C04-DMP monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWEQWLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 613 - protein, 716 aa, Artificial Sequence
  hu11F11(ver.2)(M428L)-C04-DM monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWEQWLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 614 - protein, 716 aa, Artificial Sequence
  hu11F11(ver.2)(M428L)-F06-DMP monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGTWAGSLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 615 - protein, 716 aa, Artificial Sequence
  hu11F11(ver.2)(M428L)-F06-DM monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGTWAGSLHGYVFGCGTKLTVLGGGGSGGGGSGGGGSGGGGSEVQLLESGGGLVQPGGSLRLSCAASGFTFSSYDMSWVRQAPGKCLEWVSAISYDQGNTYYADSVKGRFTISRDNSKNTLYLQMNSLRAEDTAVYYCAKGVLTTLMNWFDYWGQGTLVTVSS

SEQ ID NO: 616 - protein, 716 aa, Artificial Sequence
  hu11F11(ver.2)(M428L)-VH2-DMP bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISGSQGNTYYADSVKGRFTISRDNSKNTLYLQMNSLRAEDTAVYYCAKGVLTTLANWFDYWGQGTLVTVSS

SEQ ID NO: 617 - protein, 716 aa, Artificial Sequence
  hu11F11(ver.2)(M428L)-VH2-DM bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISGSQGNTYYADSVKGRFTISRDNSKNTLYLQMNSLRAEDTAVYYCAKGVLTTLANWFDYWGQGTLVTVSS

SEQ ID NO: 618 - protein, 716 aa, Artificial Sequence
  hu11F11(ver.2)(M428L)-VH5-DMP bivalent, (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGSTYYADSVKGRFTISRDNSKNTLYLQMNSLRAEDTAVYYCAKGVLTTLMNWFDYWGQGTLVTVSS

SEQ ID NO: 619 - protein, 716 aa, Artificial Sequence
  hu11F11(ver.2)(M428L)-VH5-DM bivalent, (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGSTYYADSVKGRFTISRDNSKNTLYLQMNSLRAEDTAVYYCAKGVLTTLMNWFDYWGQGTLVTVSS

SEQ ID NO: 620 - protein, 716 aa, Artificial Sequence
  hu11F11(ver.2)(M428L)-VH5-DMP monovalent, (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGSTYYADSVKGRFTISRDNSKNTLYLQMNSLRAEDTAVYYCAKGVLTTLMNWFDYWGQGTLVTVSS

SEQ ID NO: 621 - protein, 716 aa, Artificial Sequence
  hu11F11(ver.2)(M428L)-VH5_DM monovalent, (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGSTYYADSVKGRFTISRDNSKNTLYLQMNSLRAEDTAVYYCAKGVLTTLMNWFDYWGQGTLVTVSS

SEQ ID NO: 622 - protein, 716 aa, Artificial Sequence
  hu11F11(ver.2)(M428L)-VH-DMP6 bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYSQGNTYYADSVKGRFTISRDNSKNTLYLQMNSLRAEDTAVYYCAKGVLTTLANWFDYWGQGTLVTVSS

SEQ ID NO: 623 - protein, 716 aa, Artificial Sequence
  hu11F11(ver.2)(M428L)-VH6-DM bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYSQGNTYYADSVKGRFTISRDNSKNTLYLQMNSLRAEDTAVYYCAKGVLTTLANWFDYWGQGTLVTVSS

SEQ ID NO: 624 - protein, 716 aa, Artificial Sequence
  hu11F11(ver.2)(M428L)-VH7-DMP bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISYDQGSTYYADSVKGRFTISRDNSKNTLYLQMNSLRAEDTAVYYCAKGVLTTLMNWFDYWGQGTLVTVSS

SEQ ID NO: 625 - protein, 716 aa, Artificial Sequence
  hu11F11(ver.2)(M428L)-VH7-DM bivalent, (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISYDQGSTYYADSVKGRFTISRDNSKNTLYLQMNSLRAEDTAVYYCAKGVLTTLMNWFDYWGQGTLVTVSS

SEQ ID NO: 626 - protein, 716 aa, Artificial Sequence
  hu11F11(ver.2)(M428L)-VH9-DMP bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGNTYYADSVKGRFTISRDNSKNTLYLQMNSLRAEDTAVYYCAKGVLTTLMNWFDYWGQGTLVTVSS

SEQ ID NO: 627 - protein, 716 aa, Artificial Sequence
  hu11F11(ver.2)(M428L)-VH9-DM bivalent, (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGNTYYADSVKGRFTISRDNSKNTLYLQMNSLRAEDTAVYYCAKGVLTTLMNWFDYWGQGTLVTVSS

SEQ ID NO: 628 - protein, 716 aa, Artificial Sequence
  hu11F11(ver.2)(M428L)-VH9 -DMPmonovalent, (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGNTYYADSVKGRFTISRDNSKNTLYLQMNSLRAEDTAVYYCAKGVLTTLMNWFDYWGQGTLVTVSS

SEQ ID NO: 629 - protein, 716 aa, Artificial Sequence
  hu11F11(ver.2)(M428L)-VH9-DM monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGDQGNTYYADSVKGRFTISRDNSKNTLYLQMNSLRAEDTAVYYCAKGVLTTLMNWFDYWGQGTLVTVSS

SEQ ID NO: 630 - protein, 716 aa, Artificial Sequence
  hu11F11(ver.2)(M428L)-VH16-DMP bivalent, (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGSQGNTYYADSVKGRFTISRDNSKNTLYLQMNSLRAEDTAVYYCAKGVLTTLMNWFDYWGQGTLVTVSS

SEQ ID NO: 631 - protein, 716 aa, Artificial Sequence
  hu11F11(ver.2)(M428L)-VH16-DM bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGSQGNTYYADSVKGRFTISRDNSKNTLYLQMNSLRAEDTAVYYCAKGVLTTLMNWFDYWGQGTLVTVSS

SEQ ID NO: 632 - protein, 716 aa, Artificial Sequence
  hu11F11(ver.2)(M428L)-VH16-DMP monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGSQGNTYYADSVKGRFTISRDNSKNTLYLQMNSLRAEDTAVYYCAKGVLTTLMNWFDYWGQGTLVTVSS

SEQ ID NO: 633 - protein, 716 aa, Artificial Sequence
  hu11F11(ver.2)(M428L)-VH16-DM monovalent (HC 1, -hole)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISGSQGNTYYADSVKGRFTISRDNSKNTLYLQMNSLRAEDTAVYYCAKGVLTTLMNWFDYWGQGTLVTVSS

SEQ ID NO: 634 - protein, 716 aa, Artificial Sequence
  hu11F11(ver.2)(M428L)-VH27-DMP bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISYDQGSTYYADSVKGRFTISRDNSKNTLYLQMNSLRAEDTAVYYCAKGVLTTLMNWFDSWGQGTLVTVSS

SEQ ID NO: 635 - protein, 716 aa, Artificial Sequence
  hu11F11(ver.2)(M428L)-VH27-DM bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISYDQGSTYYADSVKGRFTISRDNSKNTLYLQMNSLRAEDTAVYYCAKGVLTTLMNWFDSWGQGTLVTVSS

SEQ ID NO: 636 - protein, 716 aa, Artificial Sequence
  hu11F11(ver.2)(M428L)-VH32 -DMP bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISYDQGNTYYADSVKGRFTISRDNSKNTLYLQMNSLRAEDTAVYYCAKGVLTTLANWFDYWGQGTLVTVSS

SEQ ID NO: 637 - protein, 716 aa, Artificial Sequence
  hu11F11(ver.2)(M428L)-VH32-DM bivalent(HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYAMSWVRQAPGKCLEWVSAISYDQGNTYYADSVKGRFTISRDNSKNTLYLQMNSLRAEDTAVYYCAKGVLTTLANWFDYWGQGTLVTVSS

SEQ ID NO: 638 - protein, 716 aa, Artificial Sequence
  hu11F11(ver.2)(M428L)-VH35-DMP bivalent (HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVPDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYDQGSTYYADSVKGRFTISRDNSKNTLYLQMNSLRAEDTAVYYCAKGVLTTLMNWFDSWGQGTLVTVSS

SEQ ID NO: 639 - protein, 716 aa, Artificial Sequence
  hu11F11(ver.2)(M428L)-VH35-DM bivalen t(HC)
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGKGGGGSGGGGSGGGGSQSVLTQPPSASGTPGQRVTISCTGSSSNIGSNDVSWYQQLPGTAPKLLIYAQSNRPSGVSDRFSGSKSGTSASLAISGLRSEDEADYYCGAWDDSLHGYVFGCGTKLTVLGGGGSGGGGSGGGGSGGGGSEVQLLESGGGLVQPGGSLRLSCAASGFTFSSYDMSWVRQAPGKCLEWVSAISYDQGSTYYADSVKGRFTISRDNSKNTLYLQMNSLRAEDTAVYYCAKGVLTTLMNWFDSWGQGTLVTVSS

SEQ ID NO: 640 - protein, 450 aa, Artificial Sequence
  CH11F11 (IGG)
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - protein, 450 aa, Artificial Sequence
  CH11F11 (IGG) WITH HOLE MUTATION AT FC
EVQLQESGGGLVQPGGSLRLSCATSGFTFSDFYMEWVRQPPGKRLEWIAASRNKANDYTTEYSASVKGRFIVSRDTSQSILYLQMNALRAEDTAIYYCARDAHGKPFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 642 - protein, 452 aa, Artificial Sequence
  CH3A9 (IGG)
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - protein, 452 aa, Artificial Sequence
  CH3A9 (IGG) WITH HOLE MUTATION AT FC
EVQLQESGGGLVKPGGSLKLSCAASGFTFSSYAMSWVRQTPEKRLEWVATISNGGGYTYYPDSVKGRFTISRDNAKNTLYLQMSSLRSEDTAMYYCARHITTVRPTKYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 644 - protein, 450 aa, Artificial Sequence; identical to SEQ ID NO: 561
  hu11F11(ver.2 (IGG)

SEQ ID NO: 645 - protein, 450 aa, Artificial Sequence
  hu11F11(ver.2 (IGG) WITH HOLE MUTATION AT FC
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 646 - protein, 450 aa, Artificial Sequence
  hu11F11(ver.2 (IGG), M428L MUTATION
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 647 - protein, 450 aa, Artificial Sequence
  hu11F11(ver.2 (IGG), M428L, HOLE MUTATION
EVQLVESGGGLVQPGGSLRLSCATSGFTFSDFYMEWVRQPPGKRLEWIAASRNKANDYTTEYSASVKGRFTVSRDDSKSSLYLQMNSLRAEDTAIYYCARDAHGKPFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHNHYTQKSLSLSPGK

SEQ ID NO: 648 - protein, 7 aa, Artificial Sequence
  Synthetic
DNSQRPS

SEQ ID NO: 649 - protein, 19 aa, Artificial Sequence
  Synthetic
AIRNKANDYTTEYADSVKG

SEQ ID NO: 650 - protein, 11 aa, Artificial Sequence
  Synthetic
GAWDDSLRGYV

SEQ ID NO: 651 - protein, 8 aa, Artificial Sequence
  Synthetic
LLIYANSN

SEQ ID NO: 652 - protein, 9 aa, Artificial Sequence
  Synthetic
GAWDDSLNG

SEQ ID NO: 653 - protein, 9 aa, Artificial Sequence
  Synthetic
AISYDNGND

The invention claimed is:

1. An anti-α-synuclein (α-syn)/anti-insulin-like growth factor 1 receptor (IGF1R) bispecific antibody, comprising:
   a) an anti-α-syn antibody or an antigen binding fragment thereof; and
   b) an anti-IGF1R antibody or an antigen binding fragment thereof comprising
      i) a heavy chain variable region (VH) comprising a heavy chain complementarity-determining region (CDR) 1 (H-CDR1) that comprises SEQ ID NO: 1, an H-CDR2 that comprises SEQ ID NO: 13, an H-CDR3 that comprises SEQ ID NO: 52, and
      ii) a light chain variable region (VL) comprising a light chain CDR1 (L-CDR1) that comprises SEQ ID NO: 98, an L-CDR2 that comprises SEQ ID NO: 117, and an L-CDR3 that comprises SEQ ID NO: 152.

2. The bispecific antibody of claim 1, wherein the VH and the VL comprise SEQ ID NOs: 221 and 340, respectively.

3. The bispecific antibody of claim 1, wherein the VH and the VL comprise SEQ ID NOs: 222 and 341, respectively.

4. The bispecific antibody of claim 1, wherein the anti-IGF1R fragment is selected from an scFv, (scFv)$_2$, scFv-Fc, Fab, Fab', and F(ab')$_2$.

5. The bispecific antibody of claim 4, wherein the bispecific antibody comprises an anti-IGF1R scFv comprising, from N-terminus to C-terminus, SEQ ID NO: 341, SEQ ID NO: 411, and SEQ ID NO: 222.

6. The bispecific antibody of claim 1, wherein the anti-α-syn antibody is of the IgG1, IgG2, IgG3, or IgG4 isotype subtype.

7. The bispecific antibody of claim 6, wherein the anti-α-syn antibody comprises an M428L mutation (Eu numbering).

8. The bispecific antibody of claim 1, wherein the bispecific antibody is monovalent for IGF1R and comprises an anti-IGF1R antibody fragment linked to the C-terminus of a heavy chain of the anti-α-syn antibody, optionally wherein the two heavy chains of the anti-α-syn antibody comprise knob-in-hole mutations.

9. The bispecific antibody of claim 1, wherein the anti-α-syn antibody or antigen binding fragment thereof comprises
an H-CDR1 comprising SEQ ID NO: 434,
an H-CDR2 comprising SEQ ID NO: 435,
an H-CDR3 comprising SEQ ID NO: 438,
an L-CDR1 comprising SEQ ID NO: 443,
an L-CDR2 comprising SEQ ID NO: 444, and
an L-CDR3 comprising SEQ ID NO: 445.

10. The bispecific antibody of claim 9, wherein the anti-α-syn antibody or antigen binding fragment thereof comprises a VH and a VL comprising
SEQ ID NOs: 523 and 542,
SEQ ID NOs: 531 and 548,
SEQ ID NOs: 533 and 548, or
SEQ ID NOs: 534 and 548,
respectively.

11. The bispecific antibody of claim 9, wherein the anti-α-syn antibody or antigen binding fragment thereof comprises a VH and a VL comprising SEQ ID NOs: 532 and 548, respectively.

12. A method of reducing α-synuclein aggregates in a human subject in need thereof who has an α-synucleinopathy, the method comprising administering to the subject the bispecific antibody of claim 9.

13. The method of claim 12, wherein the α-synucleinopathy is selected from Parkinson's disease, Parkinson's disease dementia, dementia with Lewy bodies, Lewy body variant of Alzheimer's disease, combined Alzheimer's and Parkinson's disease, and multiple system atrophy.

14. A pharmaceutical composition comprising the bispecific antibody of claim 1 and a pharmaceutically acceptable excipient.

15. An anti-α-synuclein/anti-IGF1R bispecific antibody, wherein the bispecific antibody comprises a first heavy chain and a second heavy chain comprising SEQ ID NOs: 614 and 589, respectively; and two identical light chains each comprising SEQ ID NO: 566.

16. A pharmaceutical composition comprising the bispecific antibody of claim 15 and a pharmaceutically acceptable excipient.

17. A method of reducing α-synuclein aggregates in a human subject in need thereof who has an α-synucleinopathy, the method comprising administering to the subject the bispecific antibody of claim 15.

18. The method of claim 17, wherein the α-synucleinopathy is selected from Parkinson's disease, Parkinson's disease dementia, dementia with Lewy bodies, Lewy body variant of Alzheimer's disease, combined Alzheimer's and Parkinson's disease, and multiple system atrophy.

* * * * *

UNITED STATES PATENT AND TRADEMARK OFFICE
CERTIFICATE OF CORRECTION

| | | |
|---|---|---|
| PATENT NO. | : 12,071,483 B1 | Page 1 of 1 |
| APPLICATION NO. | : 16/770728 | |
| DATED | : August 27, 2024 | |
| INVENTOR(S) | : Ahn et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 678 days.

Signed and Sealed this
Fourth Day of February, 2025

Coke Morgan Stewart
*Acting Director of the United States Patent and Trademark Office*